US012655444B2

(12) United States Patent
Ting et al.

(10) Patent No.: US 12,655,444 B2
(45) Date of Patent: Jun. 16, 2026

(54) ARTIFICIAL EXPRESSION CONSTRUCTS FOR SELECTIVELY MODULATING GENE EXPRESSION IN NON-NEURONAL BRAIN CELLS

(71) Applicant: ALLEN INSTITUTE, Seattle, WA (US)

(72) Inventors: Jonathan Ting, Lake Forest Park, WA (US); Bosiljka Tasic, Seattle, WA (US); Boaz P. Levi, Seattle, WA (US); Tanya Daigle, Lake Forest Park, WA (US); Lucas T. Graybuck, Seattle, WA (US); Edward Sebastian Lein, Mercer Island, WA (US); John K. Mich, Seattle, WA (US); Adriana Estela Sedeño Cortés, Seattle, WA (US); Hongkui Zeng, Seattle, WA (US)

(73) Assignee: Allen Institute, Seattle, WA (US)

( * ) Notice: Subject to any disclaimer, the term of this patent is extended or adjusted under 35 U.S.C. 154(b) by 835 days.

(21) Appl. No.: 17/907,385

(22) PCT Filed: Mar. 26, 2021

(86) PCT No.: PCT/US2021/024525
§ 371 (c)(1),
(2) Date: Sep. 26, 2022

(87) PCT Pub. No.: WO2021/195591
PCT Pub. Date: Sep. 30, 2021

(65) Prior Publication Data
US 2023/0117172 A1    Apr. 20, 2023

Related U.S. Application Data

(60) Provisional application No. 63/001,159, filed on Mar. 27, 2020.

(51) Int. Cl.
C12N 15/85        (2006.01)

(52) U.S. Cl.
CPC .......... C12N 15/85 (2013.01); C12N 2830/15 (2013.01)

(58) Field of Classification Search
None
See application file for complete search history.

(56) References Cited

U.S. PATENT DOCUMENTS

| | | |
|---|---|---|
| 2002/0151066 A1 | 10/2002 | Rubenstein et al. |
| 2006/0127358 A1 | 6/2006 | Muzyczka et al. |
| 2008/0039413 A1 | 2/2008 | Morris et al. |
| 2017/0209600 A1 | 7/2017 | Chuah |
| 2019/0247516 A1 | 8/2019 | Cotney et al. |
| 2020/0010851 A1 | 1/2020 | Keravala |

FOREIGN PATENT DOCUMENTS

| | | |
|---|---|---|
| WO | 2013155222 A2 | 10/2013 |
| WO | 2019068854 A1 | 4/2019 |
| WO | WO2019199867 A1 | 10/2019 |

OTHER PUBLICATIONS

Canadian Office Action mailed Jan. 25, 2024 for Canadian Application No. 3,173,609, a foreign counterpart to U.S. Appl. No. 17/907,385, 5 pages.
Chan et al., "Engineered AAVs for efficient noninvasive gene delivery to the central and peripheral nervous systems," Nat. Neurosci., vol. 20, No. 8, 2017, pp. 1172-1179.
Choi, et al., "Optimization of AAV expression cassettes to improve packaging capacity and transgene expression on neurons", Molecular brain, vol. 7, No. 17, 2014, 10 pages.
Daigle, et al., "A Suite of Transgenic Driver and Reporter Mouse Lines with Enhanced Brain-Cell-Type Targeting and Functionality," Cell, vol. 174, 2018, pp. 465-480.e22.
Gong et al., "Targeting Cre recombinase to specific neuron populations with bacterial artificial chromosome constructs," J. Neurosci., vol. 27, No. 37, 2007, pp. 9817-9823.
Hodge et al., "Conserved cell types with divergent features in human versus mouse cortex," Nature, vol. 573, No. 7772, 2019, pp. 61-68.
Invitation to Pay Additional Fees for International Application No. PCT/US2021/024525, 2 pages.
Search Report and Written Opinion Dated Oct. 20, 2021 for International Application No. PCT/US2021/024525, 11 pages.
Taniguchi, et al., "A resource of Cre driver lines for genetic targeting of GABAergic neurons in cerebral cortex," Neuron, vol. 71, 2011, pp. 995-1013.
Tasic, "Single cell transcriptomics in neuroscience: cell classification and beyond," Curr. Opin. Neurobiol., vol. 50, 2018, pp. 242-249.
Tasic, et al., "Shared and distinct transcriptomic cell types across neocortical areas," Nature, vol. 563, No. 7729, 2018, pp. 72-78.
Zeng & Sanes, "Neuronal cell-type classification: challenges, opportunities and the path forward," Nat. Rev. Neurosci., vol. 18, 2017, pp. 530-546.
Partial European Search Report mailed Apr. 9, 2024 for European Application No. 21774065.3, a foreign counterpart to U.S. Appl. No. 17/907,385, 14 pages.
Search Report and Written Opinion for European Application No. 21774065.3, Dated Jul. 1, 2024, 13 pages.

*Primary Examiner* — Allison M Fox
*Assistant Examiner* — Gina Pronzati
(74) *Attorney, Agent, or Firm* — C. Rachal Winger; Chrystal Quisenberry; Lee & Hayes PC

(57)        ABSTRACT

Artificial expression constructs for selectively modulating gene expression in selected central nervous system cell types are described. The artificial expression constructs can be used to selectively express synthetic genes or modify gene expression in astrocytes, oligodendrocytes, microglia, pericytes, SMC, or endothelial cells.

20 Claims, 254 Drawing Sheets

Specification includes a Sequence Listing.

| Brain Region | Cell subclass | Vector ID | Brain Region | Cell subclass | Vector ID |
|---|---|---|---|---|---|
| Pan-brain | Astrocyte | CN2084 | Pan-brain | Oligodendrocyte | CN2108 |
| Pan-brain | Astrocyte | CN2085 | Pan-brain | Oligodendrocyte | CN2109 |
| Pan-brain | Astrocyte | CN2086 | Pan-brain | Microglia | CN2110 |
| Pan-brain | Astrocyte | CN2083 | Pan-brain | Microglia | CN2111 |
| Pan-brain | Astrocyte | CN2087 | Pan-brain | Microglia | CN2112 |
| Pan-brain | Astrocyte | CN2088 | Pan-brain | Microglia | CN2113 |
| Pan-brain | Astrocyte | CN2089 | Pan-brain | Microglia | CN2114 |
| Pan-brain | Astrocyte | CN2082 | Pan-brain | Microglia | CN2115 |
| Pan-brain | Oligodendrocyte | CN2090 | Pan-brain | Microglia | CN2116 |
| Pan-brain | Oligodendrocyte | CN2091 | Pan-brain | Microglia | CN2117 |
| Pan-brain | Oligodendrocyte | CN2092 | Pan-brain | Microglia | CN2118 |
| Pan-brain | Oligodendrocyte | CN2093 | Pan-brain | Microglia | CN2119 |
| Pan-brain | Microglia | CN2094 | Pan-brain | Astrocyte | CN2120 |
| Pan-brain | Microglia | CN2095 | Pan-brain | Astrocyte | CN2121 |
| Pan-brain | Microglia | CN2096 | Pan-brain | Astrocyte | CN2122 |
| Pan-brain | Astrocyte | CN2097 | Pan-brain | Oligodendrocyte | CN2123 |
| Pan-brain | Astrocyte | CN2098 | Pan-brain | Oligodendrocyte | CN2124 |
| Pan-brain | Oligodendrocyte | CN2099 | Pan-brain | Oligodendrocyte | CN2125 |
| Pan-brain | Astrocyte | CN2100 | Pan-brain | Oligodendrocyte | CN2126 |
| Pan-brain | Astrocyte | CN2101 | Pan-brain | Oligodendrocyte | CN2127 |
| Pan-brain | Astrocyte | CN2102 | Pan-brain | Microglia | CN2128 |
| Pan-brain | Astrocyte | CN2103 | Pan-brain | Microglia | CN2129 |
| Pan-brain | Oligodendrocyte | CN2104 | Pan-brain | Microglia | CN2130 |
| Pan-brain | Oligodendrocyte | CN2105 | Pan-brain | Microglia | CN2131 |
| Pan-brain | Oligodendrocyte | CN2106 | Pan-brain | Microglia | CN2132 |
| Pan-brain | Oligodendrocyte | CN2107 | Pan-brain | Microglia | CN2133 |

FIG. 2 cont'd

| Brain Region | Cell subclass | Vector ID |
|---|---|---|
| Pan-brain | Microglia | CN2134 |
| Pan-brain | Astrocyte | CN2141 |
| Pan-brain | Astrocyte | CN2142 |
| Pan-brain | Astrocyte | CN2143 |
| Pan-brain | Astrocyte | CN2144 |
| Pan-brain | Astrocyte | CN2145 |
| Pan-brain | Astrocyte | CN2146 |
| Pan-brain | Astrocyte | CN2147 |
| Pan-brain | Astrocyte | CN2148 |
| Pan-brain | Astrocyte | CN2149 |
| Pan-brain | Astrocyte | CN2150 |
| Pan-brain | Astrocyte | CN2151 |
| Pan-brain | Astrocyte | CN2152 |
| Pan-brain | Astrocyte | CN2153 |
| Pan-brain | Oligodendrocyte | CN2154 |
| Pan-brain | Oligodendrocyte | CN2155 |
| Pan-brain | Oligodendrocyte | CN2156 |
| Pan-brain | Oligodendrocyte | CN2157 |
| Pan-brain | Oligodendrocyte | CN2158 |
| Pan-brain | Oligodendrocyte | CN2159 |
| Pan-brain | Oligodendrocyte | CN2160 |
| Pan-brain | Oligodendrocyte | CN2161 |
| Pan-brain | Oligodendrocyte | CN2162 |
| Pan-brain | Oligodendrocyte | CN2163 |
| Pan-brain | Oligodendrocyte | CN2164 |
| Pan-brain | Oligodendrocyte | CN2165 |

| Brain Region | Cell subclass | Vector ID |
|---|---|---|
| Pan-brain | Oligodendrocyte | CN2167 |
| Pan-brain | Oligodendrocyte | CN2168 |
| Pan-brain | Microglia | CN2169 |
| Pan-brain | Microglia | CN2170 |
| Pan-brain | Microglia | CN2171 |
| Pan-brain | Microglia | CN2172 |
| Pan-brain | Microglia | CN2173 |
| Pan-brain | Microglia | CN2174 |
| Pan-brain | Microglia | CN2175 |
| Pan-brain | Microglia | CN2176 |
| Pan-brain | Microglia | CN2177 |
| Pan-brain | Microglia | CN2178 |
| Pan-brain | Microglia | CN2179 |
| Pan-brain | Microglia | CN2180 |
| Pan-brain | Microglia | CN2181 |
| Pan-brain | Microglia | CN2182 |
| Pan-brain | Microglia | CN2183 |
| Pan-brain | Microglia | CN2184 |

FIG. 2 cont'd

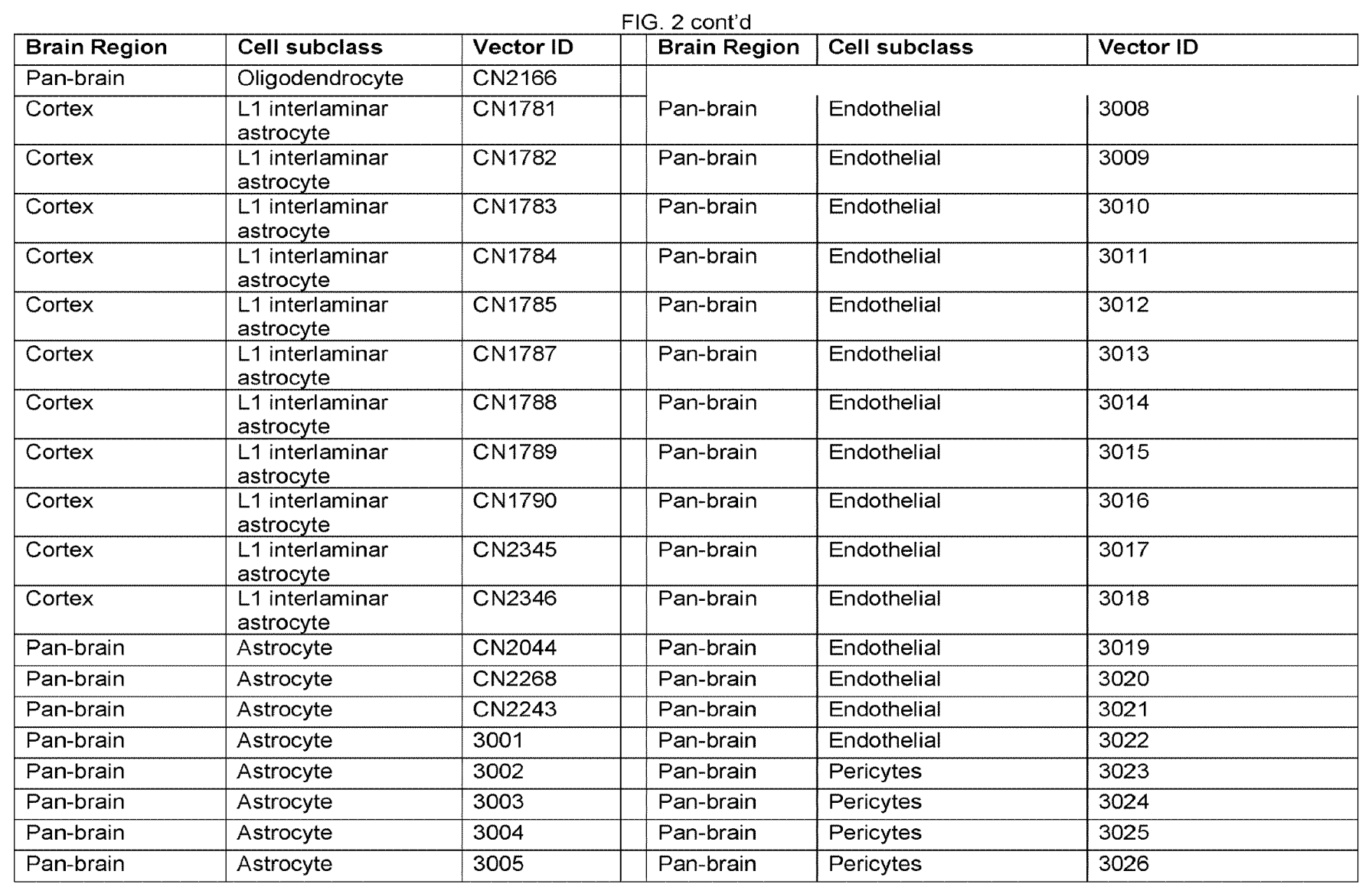

| Brain Region | Cell subclass | Vector ID | Brain Region | Cell subclass | Vector ID |
|---|---|---|---|---|---|
| Pan-brain | Oligodendrocyte | CN2166 | | | |
| Cortex | L1 interlaminar astrocyte | CN1781 | Pan-brain | Endothelial | 3008 |
| Cortex | L1 interlaminar astrocyte | CN1782 | Pan-brain | Endothelial | 3009 |
| Cortex | L1 interlaminar astrocyte | CN1783 | Pan-brain | Endothelial | 3010 |
| Cortex | L1 interlaminar astrocyte | CN1784 | Pan-brain | Endothelial | 3011 |
| Cortex | L1 interlaminar astrocyte | CN1785 | Pan-brain | Endothelial | 3012 |
| Cortex | L1 interlaminar astrocyte | CN1787 | Pan-brain | Endothelial | 3013 |
| Cortex | L1 interlaminar astrocyte | CN1788 | Pan-brain | Endothelial | 3014 |
| Cortex | L1 interlaminar astrocyte | CN1789 | Pan-brain | Endothelial | 3015 |
| Cortex | L1 interlaminar astrocyte | CN1790 | Pan-brain | Endothelial | 3016 |
| Cortex | L1 interlaminar astrocyte | CN2345 | Pan-brain | Endothelial | 3017 |
| Cortex | L1 interlaminar astrocyte | CN2346 | Pan-brain | Endothelial | 3018 |
| Pan-brain | Astrocyte | CN2044 | Pan-brain | Endothelial | 3019 |
| Pan-brain | Astrocyte | CN2268 | Pan-brain | Endothelial | 3020 |
| Pan-brain | Astrocyte | CN2243 | Pan-brain | Endothelial | 3021 |
| Pan-brain | Astrocyte | 3001 | Pan-brain | Endothelial | 3022 |
| Pan-brain | Astrocyte | 3002 | Pan-brain | Pericytes | 3023 |
| Pan-brain | Astrocyte | 3003 | Pan-brain | Pericytes | 3024 |
| Pan-brain | Astrocyte | 3004 | Pan-brain | Pericytes | 3025 |
| Pan-brain | Astrocyte | 3005 | Pan-brain | Pericytes | 3026 |

FIG. 2 cont'd

| Brain Region | Cell subclass | Vector ID |
|---|---|---|
| Pan-brain | Pericytes | 3027 |
| Pan-brain | Pericytes | 3028 |

| Brain Region | Cell subclass | Vector ID |
|---|---|---|
| Pan-brain | Astrocyte | 3006 |
| Pan-brain | Astrocyte | 3007 |
| Pan-brain | Pericytes | 3029 |
| Pan-brain | Pericytes | 3030 |
| Pan-brain | Pericytes | 3031 |
| Pan-brain | Pericytes | 3032 |
| Pan-brain | Pericytes | 3033 |
| Pan-brain | Pericytes | 3034 |
| Pan-brain | Pericytes | 3035 |
| Pan-brain | Pericytes | 3036 |
| Pan-brain | Pericytes | 3037 |
| Pan-brain | SMC | 3038 |
| Pan-brain | SMC | 3039 |
| Pan-brain | SMC | 3040 |
| Pan-brain | SMC | 3041 |
| Pan-brain | SMC | 3042 |
| Pan-brain | SMC | 3043 |
| Pan-brain | SMC | 3044 |
| Pan-brain | SMC | 3045 |
| Pan-brain | SMC | 3046 |
| Pan-brain | SMC | 3047 |
| Pan-brain | SMC | 3048 |
| Pan-brain | SMC | 3049 |
| Pan-brain | SMC | 3050 |
| Pan-brain | SMC | 3051 |
| Pan-brain | SMC | 3052 |

FIG. 25

| Enhancer Name (Length) & Enhancer_Sequence |
|---|
| eHGT_373m (341)<br>ACTGATCAGCCATGCCAGCTGCCCAGGCATTTTCAATGATCCCTAGCTTTGGCTTTGG<br>CCAGGACACTCAACTCTTGTGGACACTGGCCCTGTGTCCTGCAGCAAAAGGGGAGCC<br>TTGGCCTCTTTTCCTTTTATGCAAAAGTTCTTTTAAGGCAGCGCTCTGGCCCAGTGGGC<br>AGGCAGCTGGAGTCCTCTCTGTTCCCGGCAGGGGCACTCTTCAAGGGTTGTGCCCCA<br>GCTCCTTCAGCAGCTGGAAGGCTGGTTGGCTTTTGTTTGCTTTTTCTTTCCTTTTTTTTT<br>TTTTTTTTTCCACTTCCATCCCTTACCCCAAACATTTCTCTGAAGGAATG (SEQ ID NO: 7) |
| eHGT_375m (322)<br>AGATATCTGACAATGAGCAGAAGCTTGTATAGAGTGTATAAAACAAGTTTCCCCTTCTT<br>ATTTTCTGCTTTAAAACGCACAATCTCCCACTCCCAGCCTCTTCTGTCCAGTCTATAGA<br>GTTAAAATTGACCACTGCTCGTCCTGAGCCACTTCAAAGTAATTTAGTCCAGAACGGAA<br>GGCTTGGCGCTTGGACAATCTTCATGGTGTGTTAAGATTTCTATGGCAATTGGCAAGCA<br>AGACGTTCCCATCTGAATATGTCTCAAAGAAAGCCACTTATTGACACTAAGTTGGCTAT<br>CATCAAAGACTTCATCTTCCCTCTGCA (SEQ ID NO: 8) |
| eHGT_379m (557)<br>ACCTTGATGACGTTGCTCTTCCAATACTGGAATTAAAATGACCAGCTTCGGAGCAGTAA<br>ATACAACAATGGAGATCACACAGTTCCAACCCTAAAGCACCCACTCACCATCCTGCTTT<br>GTCAAGAACTGAGCTGTTTCTAGGGTACAGGGCTTGTGTTTTTCAAACAGTAGTTGTGA<br>CCACATTCAGGGCAAGTTGAACAACCCTGAGCCAGAATTCTATGGCAACTGGCAGCCC<br>TTCCCCATCAGCCTGAAGAGGTCTATTCTCTAAGCATAAAGCACACATGACAGGGCTG<br>GTCACCTTCCAGTTTTTCAAGCCTTCTCCTTGCTGACCTGGCCAACAAGAATACTTGTT<br>GGCTGTGAACGGTCAGAACATACACAATTAAGTACAAGTGAAGGTGGGGACCATGTAT<br>ATTTGACAAAAGGGTCTTCAGAGAACTCTTTGATGTCTACATCAGGGGTTTCTAACCTG<br>AGATAGAGGGTGAGGGGCATCCATGAATTTGAAGGGGAAGATTGCATCTATCATGACT<br>TATACCCATATTTACCCCAAATACACTTCC (SEQ ID NO: 9) |
| eHGT_372m (216)<br>AAGGCACTGTGGCATACCCTATGCTGGGCTTTATTCATCAGGGAGAAAGGTATCCCCT<br>TTTATTCATGGATCTGCAACAAGACTTAGTGTCATTTCATCCAATTTTCATAGAATGGCC<br>AGTCCACTCGGCAGGGCTATGTAAAATAAGAAGAAATCTCCAGGGGGTGTTTTTATAT<br>GTGGAACCAGCAGAGTCCTGGCACGTTAGGAAGCAAACGA (SEQ ID NO: 10) |
| eHGT_384m (428)<br>AGAGCCTAACCAGGTCCACCTGGAAAATGCGACTAGGCTCAGCACAAGCTGTGCTGC<br>ACTGTTTGACCTGGCAGGCCTTCAATTTTGGGGGGCTGAATTGAGTCTGCTTTTGTTTC<br>TCAGGGAGCCTGGAAGAAAGAGGACTTGTTACAGAGGAGGAGGGGAGACAAGGAAG<br>GAACGAGTTAAGCCCTAGGCAGCATCAGCATCTTTAGTTCTTTTTCTTTTTCTCTCTTTT<br>CAAATGAGTACACCACATTGAATAGCGTGTGGAAAATTGGTCTTTCCATTGAATGAAAA<br>CGAACTGGCAAGCAACAAAACGGATAAAGGAGGGATGCCGCTGGATGTCATTTGGTTT<br>CGCGCTTGGTTTGTCAGAGGAGGAACCCAGGAGGATCCAATGTTTTAAGATGCATTTT<br>ACCTAAAGCTCTGGCCCTGCT (SEQ ID NO: 11) |
| eHGT_386m (328)<br>ACAGGGCTGGGGATCAAAGGGGGCCAGCACCATGTCTAGAGGGCAGAGATCCTGCC<br>ACTGGCTGGTGGCCCCTGGTTGTCTTGGAACTCCACCTGCTGTTCATCAGCAGGGCTA<br>TGGGAATCTGGACACACCTCCTCTGGCTCAGACCAATCCCAGCTGCTGCTGGCCAGG<br>GCGGGCCTGGGCCATGGGATCTGGAGGAAAGGTCACTTGTGACTGGAAGGACAGTG<br>GGCAGGAAGAAAGAGCCAAGCTAGAGTAGGGGAGGGCACCCCTCCTTGTCCTCTAGA<br>CTTCCTGTTCCATCTCCTGTCCCTGTAGGGCTCCAGCTAAAAGC (SEQ ID NO: 12) |

| FIG. 25 cont'd |
|---|
| Enhancer Name (Length) & Enhancer_Sequence |
| eHGT_390m (696)<br>TCCAGACCTTGAACATAAAAGGCATTTTATACCCGCAATTGTTCATTTAATGAGCAATTG<br>CGGAGTGCAGGCCGGTTAAGGGATTGAGCTATATGCACTATTATTGCAAGAAGTATTC<br>CGAAATACCAGAAATAGGACGTAAGCTCTGATCAGGGAGACTGCGAGCACAATTACCT<br>TCTTTTCAAATCCTTCTGTGACACTGCGGGAGGAAAAAGGACTTTGAAACTTGAAAGGA<br>AAGAGCTTGCTTTCAACCTCAAAAGCTAGGAGGAAAGGGCTCTGAAATTTGCTCAGAA<br>TTCCCAATTCACCATTAGCCTGTTTCTTCCTTTAGCCTCAAGGCATTCTCCGCTTTTTGA<br>AAAGATGTTAAGAAATTCAGTCACAATAGAGAGCCTAGTTTTGAACATGTTTCACTCGG<br>TCCATTGAGGTCTGGGCTCCAGCCTTTGTGTGGGGTGAATTGAGCTGAGCGGCTAGCT<br>GGTTGGAGAGAGGTGAATGAGAAGTCGCTGTGCAGTTGCAAATTCTGGCAAAGAAAAA<br>AAAAAAGCTCACCCCTTCCTTTATTTTGTAATATGCATTCCTGTACAATCCTGCCAGTGG<br>CAATCTGTGGAGTTCAGTGTGTCCCTAAGTCAATATGGAGTACTTGGTTTATAGCAACT<br>CTTGTTAAGTTTGTCTTGTAATTGAAGCTGCTGTTGACCTTGCTTGGGG (SEQ ID NO:<br>13) |
| eHGT_371m (313)<br>ATTCAGGACCAGGGCCACAGCTGCTGCCTCTTTCCCCTCCAGCCATGGTCTGAGCTCT<br>GAGAATTCTAGATGGGCCATGGCAGTGAGCTTGGGAAAGATTGCCAGGAAGACGCTG<br>AGACCTGGCTCCCAGGAGAGAGGTGTGAGGCACTGGCTGGAAGCCCAGTGCCTGGC<br>TGCCCTGGTTTCCTGGGGCCCAGACATGCGTGATTAGTCCACAGCAAAAGCCTGGCC<br>AGAAGTCAGAGGGGGAGGGGAAGGCAGGGGGAGGATGCTCTGAGTTTGGCAGGGAG<br>AGACCAAAACAGAGTGGGGCTGGGATGAG (SEQ ID NO: 14) |
| eHGT_391m (520)<br>AGGTTTGCCCTACCTGTGGGAACCCAGCTGAAGAGGGTCTGTCCATAGGTTGGGTAG<br>ATTTGCCCTGGACAAGAACGAAGAATGAACTTAAAACCCCCAAACCTAGAGTTGGTTTC<br>TAAGCTACTTAGCCAATAAGCTCTTCGTGTGTGGGACTGCTGTGACTACTGCTCTGTGC<br>CTAGCTCCACCACCAACAAATATTTCCATGAACAAGGCCCATCTCTGTCTGGGGACAA<br>GCATGTCTTTGTGATCTGCCAACCTCCTGACCACCCACAGCAGGCCATTCAAACACAG<br>GGCTTCCTATACCACTCAGAAGAGGCTTTCCCGTCTTTCTTAGAAAAGATATAAAATA<br>GTTGACTTCTCAAGGTAATTGGAGGAATGACAGAGAAGCTGAGATGTCCCTTCTACCT<br>GGGTGACCCAGCACAAGATGCACACTTAACCTGGGGACAGTGATGCTTAGCCAAAGT<br>GGCTAAATCTCTGTGCAAATCCCATGAAGGGACCCTGGACATGGGTGAATGCCGA<br>(SEQ ID NO: 15) |
| eHGT_398m (502)<br>TCACAGCCCTCAGTGACTGCTCCTCCACTACACTATCGGGAAACTGAGGCCCAGGGT<br>GGCCACATGACCCTTCCTGGGGTCTCCCCTCACTCGGGGCACAGCTAGGCAGATGAG<br>GGCATGCAGAACTTGGCCTAGCATAGCCTGGCCTAGCTCAACCTCCACCCCCATCCTG<br>GCCCTTCTCCCTACACTGAAAGAGACTTTATGGGGATAAGAAGTCACCCATTGTGTCA<br>CAGGAGACAAAGGGGCAAGAGACACAGGCTCCAGGCGCCTGGGCTGGCCATACCAC<br>CACCACACACCACCCCTCTCTGTGCCAAAGGAGGGCTGGTGAGGCACCTTGGAATTC<br>CTGCACTGGATATTTTAGAACATGGGGCGGGGGGAGGTACACCATGTCTAGATCTCCA<br>GGAAGCCCAAAGCCACCAAGCTGTCCCTTTCTCTATCTGAAACAGACACACACGAGAA<br>ACCAGAGTCACTCAAGCCAGCACACTCTCTCCCAGGACCGGTT (SEQ ID NO: 16) |

| FIG. 25 cont'd |
| --- |
| Enhancer Name (Length) & Enhancer_Sequence |
| eHGT_402m (380)<br>GCTTAGAGAAGGGCCTGGCACACAGTAGGTCCCCCTGCTGGGCTAGATGCTATTGGT<br>GGTGGCTTTTTGGTGCTTGCCTTCCTCCTGCCCCACCCTGTGCTGTCTGCCACTGTTT<br>GCACATTGTATGGTTCTTTTCATGAGGAATGTTTCAAAGAGCATGACAGAATCTTACAA<br>CAATCAGCCCATTGTCTGTGTGCTCCAGAGCCGACTCTGAGGTCCTGGGGTGGCCGG<br>AGGCTGTCAGGGAAGGGAATGGGGAGAGAGGAGGCGAGGCTTGGGTGGGCAGTGTT<br>CTGAGGGGATTGATTGCCCTCGGGAGTTGTGGTTCTTGTGTCAGAATCAGGCCTTTTG<br>TTCAGGTCTTTTTATGCACAAGCTATTTGGGACCC (SEQ ID NO: 17) |
| eHGT_409m (489)<br>TGCCTCTCAACTTCTGGGCTTTAGTTCCTAGCCTTGGACTGGAGAACAAGACTCCCCA<br>AGTCCCAGTCTCAGATCTGCCACTTTTCCTGTTTATAGGATGAAAAACACAGTTTCCCC<br>TGAAGGACAAGGAGACTCAAAACATGGAGCGTCCCAGCCTTCTCCGGGCAGTCCTAG<br>ACTCTGTTTGTCTTTACAGCAGTGATCTTAGCTCAGATAAGGTCATGTTTTGTTTTTGTC<br>TTTTGTCTTCCTGCTTGTTCCAGTCGGTCCCAGTCTTTTGAAGTGGGACTGGCTGGGA<br>GGTCACAATGTCCCTATTGTCTAGGATGACACTTCTGGGCTTAGGTCATGTGTCCAGT<br>GTTCAGAGGAACCCAGAGCCAAAAGAATCAGACACTAGAACTATCAGTGGCTTAATTG<br>TTCTGCCCTTCTCTCCAGGGCTACTGACAAGGTAAGTGTCTGTGCTTACAGAGGCCTG<br>TGGTGGCAGAATAGCTGAGCCCT (SEQ ID NO: 18) |
| eHGT413m (713)<br>TCATGAGACTCCCCTGGGGGAGAAGAGAGAGTCAGAGAGTCAGACTGTCATGCCCAG<br>AGAGTGGCTGGCTCCTACCCCCGGAAATGGGCCTCTTACTGTGACTGCCCTGGGGCC<br>AGCCGAACAGCTGCGTTGGCCGAGCAGGAAGTGGTGAACAGGCTGGACCCTGTTCCA<br>GCACGTTGTGGGGGAAAGAAAGAAAAAGAAAAAAAAGTTCCATCAGAGAAACTGCA<br>CGCTAGCTTAGGCCAAGGCTGATCACTGACCTCCTGTGTGGTACAATCGATCTGGACC<br>AACCACTTCCCCCTTATTCTTCCCCGTATGGGAAAGTCGGTGCAGGTGCGCAGGGCCA<br>CACAAAGCAGCTTGGGAGATAGCAGCCCAGGAAAAATAATTCCACCTGTAAACACCTG<br>TGTTAACAAGTGCTGTATTTGTTCAGCTATTTTCTTTTTCAAACACTGTTTACACACACCT<br>ATTCTCTTACCTCGGTCAGGTGTGTCTTGCATGGCATCTGGGGACCCACTGGCAGGAG<br>TCCAGGGTGCCTCAGAAATGCCTGTGTCCTCTGCCCAGCAATGTAGGGCTGGGACTG<br>CCAGGCTCTCAGCTGGAGTGCCAGTGCTGCTGGGTCAGCCTCTTGGAATGCTTTCAG<br>GTCCCTAGGTGCTTAAGGTTGGGAGACTTCACGTGACCAGAAGGGCCTGTCCGGGGG<br>ACAGTGACCCCAGCTGGATG (SEQ ID NO: 19) |
| eHGT_414m (363)<br>GCTGCCCCTTGGGGTCTTTTAAGCTACTGAAAACTCTGTGGAGACAGCAAGTCAAAGG<br>CCTCCTACAGACGGGAAGCAGAAGTGATGCTGAAGGGAGCCATGGGGGCACCTGGG<br>ACTGTTCAATGCCGAAAGTGACTGGATTGAAAGAAGCACCAGAAAGACAGGGAAGACC<br>TGAAGTCACCTCCCTGTCCTCTCTAGACACCGGAATCTTCAGCTAAGAGAAGTGAATG<br>TATGAGACACCTTCTCTTCCTCATGGGTCTGAAGAGATATTGAGAGGACGGAAGCTAG<br>ACACAGTCTGCAGGAGGGACAGATGGATTCAAAGGGGCAGGTCTCGGAGGCTACGTG<br>ACAAGGTCTGGTGCCTGG (SEQ ID NO: 20) |

FIG. 25 cont'd

Enhancer Name (Length) & Enhancer_Sequence eHGT_415m (484)
AAAGCCTCGGGTCTCTGTCCCACCTAGAGATTTCGGTCTCTAGAAATGGCAGCCACCT
GCTCACACCCCAGGCACCCTTACTCCACCCCGAGATTCTGACATCACCTTCTGCTGTG
ACCAATGAATGGAGTCCCAGCAATGATGAGGATGTGAATGCCAGCTACCTCCCCCACC
CGAGGCCTGTGGTTGCAAAGATGCTCTAACAGGAAGCGGGTTTGAGGAGCTGCACAG
CTTCCTGCTCCCCCTCGAGCTGCACAGGACGAGAAGGGCTAGCGCTCAGCTTGGCCA
CGAGACACAGCTTCATGCCAGGGTTCTGGTAGCTTCCTCTTCCATATCTACTTCCGTGT
GGCCCCAGGGGCCCCCCAGAGGCAAGCGCTGCTGTCCCTTGCCCAGGCCACCCTCC
ACCTCCAGTTTGGAGCCCTGCCCCCCCTGGGGCTGGGCCAAGCCCAACTACTGACTG
GGATTCCATGGGGGACTGGTAGGT (SEQ ID NO: 21)

eHGT_383m (345)
AGGGAAGGCAGCAGTCTTGGCACCACCAGGAGACTATGCAGACAAGAGCTGGGGTTC
AGGCCAACGAGGAATCAAGGACTTAAGAGACCAAGGTCGTTTAAAATAAAGAGGCACA
GAGAAGGAAGCCTGGCATTCTCTGGTAATGCACCTTAGGCATGGGCCAATTCTTCATT
GAGCAATGTCAGAGGTTAAGAAGCTCAGTAAACTGCAGCTGAACAGAGAAGTGAGATC
TGGCAATCTCACAACACTGAGTAAACAGAAATCGGAATTCAGGGCTGCCAAGGAGAAA
GAGGTCATTTGTAAACACTCCAGCCTTTTTAGTTTGTCTGGGTCCTTGGCAAAGCT
(SEQ ID NO: 22)

eHGT_374m (292)
GATGGGTGGGACCAGGAAGGGACTGGGCAGGAGCTCATTTTGGGATAGGGGAGGGG
ACAGCTGAGGGGTTACAGATGGAGTAAAGCAAAGCCCAGGCATCCTATGGGAGGTCT
GGCTAAAAGCCAGGGTCCTACTTGCCCCCACGCTCCACCCAACTCAATCCCTGCCCCT
TAGACCTCCTCCCACCAGGGGGCTGGCTACACCCCAGTAAGTTTTAACAAGGCACCCC
TCCCCTTGGCAGGACTCACAGGGAAGGTTTTGTCTTGCTCAGCCCAGTTTCTCCAGCG
CCTCT (SEQ ID NO: 23)

eHGT_396m (320)
TCCATGGCTTCCACAGTCACTCTGCCTAGTTCTCTCCCCACCACTCAGTTGGTACCACT
GGGCCCCAAGGCAGCAAGAGAGTCAATGGCTCCTTTTCTCTGTGAGTGTGATGGATCT
GGGGTGGGGGAGGAGATGTCCAATAGCTGTCTTTGCAGCAGCCATAGACACAATGTA
CAAAGCCCATCTTGTTCTTTAGCCTGAGCTTCAGGTCCAACAATATACACTATGGGGAC
AGGAGAGCAATCCCCAGCTACAGCTATCTATCTGCAGGGATGCTTGACATTCTGCTCT
GGGTAACAGGGCTAGGGTTGTTCAGCTGA (SEQ ID NO: 24)

eHGT_381m (242)
CAGGGCTGTCTCAGTTGCCTAGGAACACTTAGTTAATAGTGATTCCTTCCAGGGCGCT
TCAGTTCACTGCTGACCTCACTGATGATGAGTAGTTGAACAAATAAGGGAAAGAACACT
AGAGACGTTTTTGGCTTCTCTTTCACTGAAAGCATGGAAGAGGCCAAGAAGTTTTTGCC
CACGGAGTAGGAAAGAAAGTAGGACATGGAAACATCTTTTATCAAGCTTCTTACAATTG
AGCCTTC (SEQ ID NO: 25)

eHGT_382m (479)
TTAGCGGGCAAAGGACGTTTATTTGATGAGGGGTAGGAGCTTGGTCAATTCTGTGATC
CCTAGATTAGATTGTTGGGCAGACACACCCACTTTTCAGAGAGGCCATTGGCTCCTGT
GTGAAAGATACTCCCACAGCAAATGGGGGAGGGCTGGCAGCCTCATTTGGCTTTCTG
CCATCTCTCAGAGCTGGGTCCTGGTGTGCTTTGGGGAAGCGTCTCTGGCAGATCCCT
GCTAGCTAGTGTTTCCTGACATTTGTTTCAGAGACCTTAATAAGGTTACTGGAAAAAAA
ATTTTCTCTCTTAAAATAGGTTCACTAAGCTCTGGGTTCTGCCAGGCAAGTAAGTCTTTC
ACTGGGTCTTGGATCTGCAGGGGGCTTCAGACCCCTTCCAGAGGAGGGGTTGCCTCT
GCAGAGGTCTACTGAGCAGAAAGGGACAAGATGGGAACCTTCTTTGTGAAGCTCACTT
GGTTTCAGCACCTGC (SEQ ID NO: 26)

| FIG. 25 cont'd |
| --- |
| Enhancer Name (Length) & Enhancer_Sequence |
| eHGT_387m (492)<br>TGGCTCTGGCAAAGGATGGAGATTTTTTTTTTAACCTATTCTTTTGAGAATAAGGAGGG<br>TCTTTGTTTCTCTTCCCTGGGAACCGAGCAGCCCCTTTCTCTGAGGGTAGAGTTGGGG<br>CATGGCTCAGCAGAACGACAGTCATCCTGGCTAGTAAGACTCAGAGGCTGGCCTTCAA<br>AGGCTTGAGCTCCTGGGTGACTGAGCAGTGGAGAAACAGAATCCTGCCCTTGAATTGC<br>TCCCCAGGCGGGCTTTATGCAGTCTGGGGAAGCAAGGGATGCCCTGTGATTCTTAAAG<br>AAACTGGTATAATTTTGCACTGCATAGCAGACTCCCAAGACACACAGCCTTTTCCAGGA<br>GGAGTTCCTTAGAGGGGAAGGGGATAGGTTGCAATGGTCTGCTTAGCCTCCCGAAGG<br>CTGCAGAAGCTGCTAAGACAGGGGTAACTGAAAGATAGACTCTGTGAGGTTGAACAGC<br>AATCTTTATGACCTGACCCCCTAGGCA (SEQ ID NO: 27) |
| eHGT_388m (434)<br>ACTGGTGAGTGAGTTGTGCAGTTTGCAAAACTTGGAGGTCTCCCTGGAAACAGAATAA<br>AATGCTGCAGTGTGATGTCCAGAGGGAGGGGGGCTTTTATCCCACCTCATAATTAAATCT<br>GAAAGGTTCCTGGGGCGAGCTAAGAGGTTTCTAATGAAGTACTAAGCTGTGCTTGGAG<br>TCTGCACCACGAAAGGCGCTTTGTTCTCCTTTCAAAAGGTTCCAGTGCTGAATAATTTG<br>GCTCCCAGCGCTGGCTAGTTTCAGACCACCTGCAGATTCTAATCTACGCAAATTTATTT<br>GGTACAAACTTTCTTCTACGTCACTTGGTTCAGCATAATTCCAGAGAGGTTTATTGCTAA<br>TGTTTAACAGCCATCAGAGAACAGCTGCTCTCCTGGGGCCTGCCCCTCGAAAGGGAAA<br>AAGGGGGGGAAATGGGGCTTTTGT (SEQ ID NO: 28) |
| eHGT_393m (595)<br>TCCAGAAACTGAGTCTGCAGCTTCTTAGCAGTTACTTGAGAAAAGAAGTAGAAGAACTG<br>ATTTGCTTTTACAGGCTTCTCAGCAGAATCTCCGTGGATTACTGTGCTGGGCTTTTAGT<br>AGCACAACACGTCAGTATGTCAGTGCTTACTCAATGCTATTTTCGGTTCTCCAAGTAAA<br>ATCATGAACACTGAGCCTTTTGTTCAAAGTACCATAAGGGCATTCTGATGTCCGTTCTT<br>AGTCTGAGGTTAAAATGGAGACAGCTAAACAAGTTGTAAGATCCAACTTTCTCTCTCTC<br>TCTCTCTCTCTCTCTCTCTCTCTCTCTCTCTCTCAATCTCTCTCTCTCTCTCTCT<br>CTCTCTCTCTCTCTCTCTCTCTCTCTCTCTTTCTCTCTTTTTCTCCCTCCCTTCCCTTC<br>TTATTTTTCGTGTTTTGTATTTTTTTCCTAACAACAAACAAAAGGAAGTACTCACTTGAG<br>GTGAGGACAAGGCTACTTATGTAAGAGTTGTGCAAGTGGAGAGGACATGCCCCCTGCT<br>TGGAGATTAGTCCAGCAAACAAATGATCAATTTAAAGCAGGGACAAAAGTTACTGAAAG<br>G (SEQ ID NO: 29) |
| eHGT_399m (281)<br>TCCTCCCTGTCAGTGACATCACTTGAAAAGCCCAACAATGCCCGCACACGCTTGGATT<br>TCACGTCTAGAATAGTATCTGTGTAGCCGACCTCCTGGAGATACCTGCACAAAACGGA<br>TCCTTATAGTTCAGTCACACAGGAATTAGTGTTGTAAAATTTAAAATGTAAATAAAAATA<br>TTTCTTTAAGCTCACTGACTATATAAGGTTTAAGAGAACAGTGCCATGTCAGTAAGGCT<br>TGTTAATAATATTCCAGCTGCAGATGGAGCTGTCTCTTGCAGTACC (SEQ ID NO: 30) |
| eHGT_400m (418)<br>TGGTGCGACAGAAATATGGCTAAAGCTAGTTTTGTTTTAAATAGAACATGGATTTCTAT<br>GAAAGAATTATATTGATAAATTATTAGTAGCAAGTTAAGATAAATTGTTAACATTTGTCTA<br>CTTTATGCACTAGGCACAAATACTTATTAATGAAACCCCTCATGTGTGAAGATTATTTAT<br>TTATGTTTCTCAAACAAAAATGGTATTGTATCCGATTCACTGGGTGTGCTTTGTCCAGTC<br>TGATTTTCTCATTAGCAATTCTCTGCATGATTAAATGCTAAATACACAGCTGTGTAAAGC<br>CTCAACTGGTAGTAACCAGTAGTGCCTAATACTGCTGTCTTAAAGGAATAACAATATAG<br>TCAAATACTGGATGTACAAGCTTTAAGGCCCCATTCAGCTGAAAGACCTGGGGTTATCA<br>(SEQ ID NO: 31) |

| FIG. 25 cont'd |
| --- |
| Enhancer Name (Length) & Enhancer_Sequence |
| eHGT_405m (361)<br>TCCTCTGTGCAACCCTCTGCTCTGTCTGGTGTGATACACAGAGGTTCTACACAACTGG<br>GCTATGATGGGACAAAACAAGGCTCCACTCATAGCAACTGCCTGCCCGCTCTGTGCAT<br>AAAGAAAGGGTTCTCTGTGTTGTAGCATTCTTGCCTGTCAGCTGCTCAACAAACAGATG<br>TTCATGTTCTGCTCAGAGTTCTGGCTACCCCAGGTCCAGGCAAGGCACAGAGTAGTGG<br>GGATAACTGCAGAGGAAGGGAGAAGGGGTGAGTTGGGCTTCCCATACTGCACACTTT<br>TCCTTCCCCTGATGCTGTTTGAGAGTGAGCCTCACAGTTTCACCTCCAGCAGCCCAGT<br>GCAGCCAAGTTTA (SEQ ID NO: 32) |
| eHGT_406m (320)<br>GGGAGTCCCAAATGTATTCAATCCTGACACTTAAAGAGAAATGTGGCTTCGTTTCTAAA<br>GAGCCATTCTCAATCCTATAGAGCTGCTTTCTAGTAGATGGAATACACAAGCATCTGCC<br>TGTGTCTGGTAGAAGCCTAGAAAGTAGACAATGGTTCTATTCAGGCCAAGCACTTCCC<br>CTCCAACAGGCATCTAAGCAGCACTGTGTTAGGGAGATGACTCTGACATGCCCTGAAT<br>AGATGACCGGTTTGGAGCACCTGCCCTGTGGACTGTGACAGCACAAGCCAGGGATAC<br>TGAATCTTCTGGCCTATGTCTACTGCTCT (SEQ ID NO: 33) |
| eHGT_410m (295)<br>GCACTCCAGATAGAAAGGCCCATTGTTTTCTGCATCTGAAGTTAACACTCTTCCCTTTA<br>TTCTTTCTTCCAGGCCTTTTAGTGTTTGCTTAATCAGAATATTTTAATCTCTAATGTGGTG<br>ACTAGATGTAATTTATCACATTAAGCCTCTCCTATTTTCTTCTGCTTACATGACTAACGTT<br>ATTGTGTTTTTATTGCGCTTATACAAACAAGCCTTTCCTTTGTTCCATTGTTTCAGCAATA<br>GGTCAAAAATCAACAAATAAAGCTTTATCTTTCCAATCCTGGACTCACCCACT (SEQ ID<br>NO: 34) |
| eHGT_416m (349)<br>GGACTGAGAGCCCCAGTTCCTAGACGCCCCCCAGCCACAAAACGGGGGGCCCGGTT<br>GGAGTGGAGTTTCTAAGAATAAAGCCACTTCCAGAGCGGGCAGAGATCAGGGACTTTC<br>AGGCCAGCTCCATCCAAGGGTGAGCTCAGGCAGGCCCGGCTGGCCGGGATGGGAAG<br>GGCTGACCACTTCCTGCTCAGGGCTGGCGGTCCCCCGCAGTCATCAGAAGCCAACCA<br>CTTCCCGGTCTGGGCCGCCTTCCCCTTTCTAGCCAAGCGGGAGGGTAGAGGATGAGG<br>TGGCCCTTTGCGTGCTGTGGCCTGGGCGACTCTGGCCTCTTTTCATTTCCCCACTATC<br>GCTGCGT (SEQ ID NO: 35) |
| eHGT_417m (300)<br>ACTGAGAAAAATGATTGGGCCNCTNTTTTTTTTTTTTTTTTTTTTACAGAGAGCTAATCTTG<br>AAATCAGAATCTGTAGGTAGTGGACCTTCAATGATCACTGTTTCAAATCGAGATGTGAC<br>TTTAAAAAAAAAAAAAAAAAAAAAAAGGAATTCCAGACAGCTGACTGTGGCCAACAGCAG<br>CTGTGTCACATGCTGGTCTGAGGAAGTGGTCAGAGGGCAAGCAACTCTATATTGCATT<br>TTCTTTGCAGAATGGAGCCCTCTGCAGCTGAGTGAACCCAGGGGCTGGACGTGCTCA<br>CCCTAT (SEQ ID NO: 36) |
| eHGT_418m (370)<br>AGCTCTCTGTCCTAGCACAGTGCATGACAACAAACAGGCAAAGAAGATGTTGAAAAAG<br>ATGCACACAGAATGGATGAAAGTTTGCAAAGCTCTCTCTCTCCCTCCGAGTTTTTCTTT<br>TTTTCTTTTTCCAAGATCTTCCAGAAAAAAAAAGCAGAACCTTTGACCAGACAGAGCAA<br>ACATGTCACAGAGTTCTGCTTTCACCGTATGTTAAGTGGAAATGATTGGGCAAGTGAGT<br>TGTAAGCGATTCCTCTCCGAGTTTCCTCTGAGCTGGGGGTTGATCCTGCGCACTCAGA<br>CTGACAGTGCAAAGTGTGAAGGCTTGCGCTCAGCACTCTCAAGTCCCACCGTGCCTCA<br>GCTACCTTCCATCGTGGGC (SEQ ID NO: 37) |

| FIG. 25 cont'd |
|---|
| Enhancer Name (Length) & Enhancer_Sequence |
| eHGT_419m (484) <br> CAGGAACCTGGTGACATGGGAACCAGGGCCCAAAAGATATGGGGTGGGGCAGTTCCC TAACCAGTCTGTCACGCTAGCCTTTCCACTGGCAGCCGGGCCTGGTTTGTAGTTCCAT CCAGCACTTGTCCAGGCCCACAGGCTGGGGCCTCCCCTCCCTCCCCAAAGCCCCCTC CCCAGGGCCTGTTTCCCGGAGGAGCTGGGGTCTTCCCCAGAATCCATGATTCACTCAA GCTGGGGCCTTTTCACTTCTGCTTTGGAGCTAAAAATATAGAGACCAAGGAGTCTTGTT GAGCAGGCCTCCCCACACATTGCACAATATCCCCCCTCGGCCCCTCCCCAGAACAGC TAGAGAGCTCTGCTGACGCAGGGTCCAATGTGGACCCAAACTTCTCCTAGGTTGTCTG TGCTGAGGTCAGGGCTTACGTTCACGCGCTGCTTTTGTGAGCCAGAAAGTCCCTTCCT GTAGCCCTAGTAACCCAGGCAT (SEQ ID NO: 38) |
| eHGT_420m (416) <br> AGCCCAGACTTTGCCTTCCTCCCAGGATCCCCGAGGCCTCACCCTTCCTGTGCGAACT TGCAGACTTCCCTAACTGCCACTAGGGACCACAACTGCCTGACTCACAACCAACAGGA AGCAGGCTGTGAGGGGCCAGGTGAAATGAAGTCAAAGACACAGGAAATGCTCTGAGC CAGATTTCTATCATTGCCCCAGGTGATGTCCTTTGCCTGAGTTAGCTAACTATACAACC CAGCATCCTCCCCAGGTCGAGGCAGAGCTCAGATACCATCTGTCCCAATCTCTCACCC AAATAATAAATTCTGAAGGAAACATTCCTGCAGCTCAGCCAGGCAACTTCTGCCTGTTT GTAGAAGCCCTTGAGAAACATGTGGACAGACTCACTCCTCTCTTGTGCAAGCTACACT GCCTTGGGG (SEQ ID NO: 39) |
| eHGT_421m (377) <br> ACAGGGTCCCACAAGCCAAACTGACCATTCTCATCAGCGCAGAAGAACTAACATGTGA CCACCATGGGAGGTACCCCATCTCTAATACCAGTTAATCAGAGTAGAAACATTTTTCAC CTTGGCCATTAAGGCAGATATTTTGATCATTCTGTTCTTAGTCACAAACCTCATTACATT TACAGTAATAGAAGAAGAAAAGAGAGAACCAAGGGAAAGCCCTACTCTTCTATCAGGT TTCCCCGTAAACGTCACTTCTCTCAGGAAGCCAGTCAGACAGATCTACCCCAACCGAC TTCCCCTGGCTCAGCTCTTCTCACTCATTACATTATCCCTTCCAGAATGATCTTTACCCT CTAGTCCCCAACACATTCCCCAGC (SEQ ID NO: 40) |
| eHGT_423m (297) <br> ACCTGGATCCCCCGTGTTTCTGTGGCCTGGCCTCCTGGTTCTGGGGCTGGGCAGGGA GGTAGGGAGGACCTGCCCATTGTTCCCATGTGCCAGGTGAGTCAACGCCATGTTCCC AGCTGCACCCACTCCATTCCTCTACCCTGACCTTAGGAAAGGAAGACCAAGCAGTCTT GTAAACATTTGCTCAATCCCTCAGCCACAGAGCTTACTACACAACTGCCTGCGTGGC TTCTTTGGCCATAACGCTTCTGTGCCACCTTTAGCTCTGCATTGCAGCCCAGTGCACAC AGCTCAGT (SEQ ID NO: 41) |
| eHGT_428m (213) <br> GGTGTGCTCTTGGACTCCCTCTCACGTAACTTTTTTTTTATCAATGACTAGTATTAGAAA AAAAAGATTCATTGACACAGTAACTGAAAGCTGACTGGGAAATGAGAACTAAGAAGAG GAAGTCATATCCACAGTGGCTAGGTTAGAGCCACAATCAAATTAGAGAAGCAAGTCTT CTGGGCAGGCGAAAACAAATGAGGGGAGGACGGGTCT (SEQ ID NO: 42) |

| FIG. 25 cont'd |
|---|
| Enhancer Name (Length) & Enhancer_Sequence |
| eHGT_429m (525)<br>GGAGAGTGACCTGACTACACCAGAACACATGAGTGACATGCTGAGGATTTTGTTCCCT<br>GATAACTGGCCTGGTCTGTACATGGACCATCTCGGGCTATTTTATCTGAGATCATTGGA<br>ATACTCTCCTCTTGCCATGACTAATGCTTTTCTATCTCTGAAATATGACTTCCTTTTTG<br>TTGATTCATGTAATAAACCTCAGAGTGCCTTGCAGGGTGTATCTAGTGTGTCATTACAC<br>AGAACTGGAACATTCTCTGATGTGACTAGATTAACAGTACTAACGTGGTAATCACTGGA<br>GGTCAGACATCCTGGGGAGCAGGCTGGCCTCTGTGGGTGTGGTTAGCACTCGTGATT<br>CTGGGGACTCAGGAGTTAGAGGAAGTACCATTTTAACCGAGGAGCTAAAGCTATCCCT<br>ACACAGAGCTGTCCTTGGATTTCCCCTGCCAAGTACTCATGTTTTCAGGTCTTACCCTC<br>AACTGTGTCCTGCTGCTGCTGCAACTACTACTTGCAAGTAAGTCTGGGCCTGGGC<br>(SEQ ID NO: 43) |
| eHGT_430m (315)<br>TTGAACTTGCAGGGGGCTCATTAGGTGTCCAGAGACTTTTGCTGATGGATAGCATGCA<br>CTGGGCATGAGCCTGCTGGCTTTGACATTTTCAAACTGCACACTTCCTACAGCGACAG<br>CGTGCCAAAGCCATGGGCCTCACTGCCATCTTCTCAAAACCAGGAAATGAAACTGGCC<br>ACTAAGAGCAAGTGACCACGAGCCAGGGCATTGGTGCAAACCAAGCAAAACACGCTG<br>TCGGCAGCCTAGGTCACAAGGAGGAACGCATCTCATTTGCAGCAATCTTTGAAGAAAT<br>GGTCCACTCCTGCTCCTCATCCTGGC (SEQ ID NO: 44) |
| eHGT_376m (509)<br>TGACACTTGCAAGCAGTTCACTTATTATGGAAAAGCATGGCTTCAGTGGCCACCAGCG<br>CAGTGGGAGGAGACCTGAAGAACACAAAACAATTCCGTCCTCTGTATCTTCAGTAGAG<br>CTGGCTCCAGAAGAGGGTCCAGTTCTGAAACATGGAACATTCTCCCCATTGGGCTCTC<br>TGGGAAAAGGCCTCAGTATTGTAGAGGGTGCCTCTAGCTATTCAGGTCTTGCCAAGGA<br>GAACGGCCAAGAAAGACAAGAGGTCACATGGCCAGGCCTGCAGCCGGCACAAAATGT<br>TCTGAGCAACTAACTGATGGCTGGACAGGGACCAGGACTGACCCTGACCCTACGTTG<br>AGTTTTCTAAGAGAGGTAGGCCAACACATGATGCAAAGGATTCTATTGTTGCTTCTGCA<br>AAGCAAGATTTGAGTTAACATGAGTTGTATGTCTCTTCTAAATGAAGAGACATGAATTTT<br>TTTTCTCATATGTACTTTTTTAAACATTGCAATAACCCAGTTAC (SEQ ID NO: 45) |
| eHGT_380m (503)<br>GGCTGAGCCCTGTACTGACCAAGCAACCTGCAGAGGGTGGGGGCGACTGAGGGAGC<br>CTGGCTTTGGGGGTCAGCTTTGTCCTGTTAGATGGAGGGACGGACACCAGAGGTTTG<br>GGGACTTTCCTTCGTCTCACTTCTACCTGAGGGGTGGGGGAAGGTAGAAAGGCTAGA<br>ATGCTGGTTGGCAGGGCTTGAGTTCAGGCAGTCCTGGGAACCTTGCCTGAAGTGCCT<br>GAGACAGAACAGCCATGAAGGCTGGCCTGACCAGGCTAGCCAAGGGGCAGGAGCAG<br>GGCATTTTTCATTCATATTCCTGCCTCTGCATGGCAGCCCACATTGCCACCCCTGTTCC<br>TGGGCTCCCAGCCTGATCCCAGGCTCTGCCTGCCCCTTGGCAGCCACCACCCAGCCT<br>ATCCACCCAGATACTTTCGAATTCCCATGCTTCTAACCGCTCCCTGGCCCCTGTGGGG<br>TAGGTGTGCTGAAAGAGGCTCAGGCACAATGTGGATGTGTACATGT (SEQ ID NO: 46) |

FIG. 25 cont'd

Enhancer Name (Length) & Enhancer_Sequence eHGT_385m (654)
GCCCTCCCGCTTCTTTCTTGTCTTCAACAAGAAATTAATATCTCAAGATAACTCCGATGT
GTTGGTCCCAGCCAGAACACTTGAAAGACACGTTCAATTAGGGCCACAGCATTGCTTC
TGGAGTGAACGGCTATCACACTGCCCTGGAGTTCAGTCTCCTCTGCACACACATAAAC
ACAAGTGCACAGCGCCCCAATGCTGTTGTCCCCTCAGCCTTCCAGCACTGCCAGTTGG
CAAACCCAAGCCAGGAAGTTGTCAATTCCAATTGCGTTTAGGCCATGTAGTCCTATTAA
AGAAGGCTTGCTGGTTAAGGGGCATCCTCTGTTTCCAAAGCATGGGAAAAAAGAAAAA
AAAAAAAAAAGGCTGTGCTTAGATTGGAGCTGGCAACTTCCACTGACTAGAATTTTCAA
GGGGCTGTGAATGAGTTTAACAAAGGAGGTCTGTGGCTAGTTTCTGGCTGAAGTCCAT
GTCAACAGTTTTTAAGGTCACAGGCCACACTAACTAACATTTATTCCCAGCAGACCCTG
TTCTAAACACAAGCTGTACATAGTACAAATTTGAAATTTTTCTGTAATCCCTTGAGATATT
CCTGATCCCTCCACATGTTTCTGCTCAATTAAAAACAATTCTCACTTCTCACCACAAGAG
AGGCCA (SEQ ID NO: 47)

eHGT_397m (446)
AAGCCGCTTTGAATGCTGCATGAAACAGCTAAATTCGTTCTGCTCTTGAATGAGTTCCC
TTAGCGGGCAATAGTTTTCTGAGGCTTTGAAATGATCACTAATACTCGAGTGAGTCTTA
CAGCACTTCTGGAGTGGACCAGAGCACTTCTCAATACAAACCAGCAGATGAGGTCATG
GTCATGCAAGTCGTCGGGGGGGGGGGGGGTGGCAGCAACAATCATTGTCAAAGGGGT
GTTTTCTGTAGATGAGAGAATGAAACTATTGTACAAAACTCAATGGGCGCCAAGCATGT
GGCCCAATTATTTCGCCTGTATGAGCATGGCACGGAAGGCTCTCCTTAGAGAACTCAA
TTCACACATTTGTGTTTTGTCTTGTATTCATGGGCAAAAGCCTAGAGACTTTCAACCTAA
GAGGCTTCACCAAGTTCCTGTCTTTTAAACCTAGAAC (SEQ ID NO: 48)

eHGT_401m (315)
TACGGCCTGGGAATGCAGAGTGACAGGGTTGATAATCTGCATGGCTCTTCCCCACTCA
AGTGCTCAGTGGTCAACAGCAACAGGACAACACGGGCTTATGTCCTGAGGAAGGCAG
CTGCTGGGGACAGGGGTGGAACAGAGGCAGCTGGGGGTGGAGAGGAGCCTGTTACC
AGCTGCACAATGGATTTCTCAGCTACCAGCAACCCCTCTGGGTGACACCTAGCTATTA
CAGTTCTCATAGCCAGCTCTCCTCATAGGGCAAGAAGAAAGTATGGCTCCAGGGAGTG
GCCCCTGCACACGCTAATGCTATGCCCT (SEQ ID NO: 49)

eHGT_403m (393)
CTTCAGGCGCTGGGAAGCTACCCAGGGAGTCAGAGAGCCAGAGCAACTAGGACTCAA
CTCTGTAGAGACAAGCTAGCATCTGATCTAGCCCTGTTGCCTTGACAATGGCTCATATC
CCAGGCACCCTAGGCACCCACAGGAGCAATTAGTGAGTGTGGGAGAGGGTTTCTATG
GTGGCGGTCCCAAGGACCTAGGGAAGAACAAGGGCCAGCAGGACCTTTCTCCTTTGT
CCTGAGCACACTAGGCCTTTGTTCTTCTCTGGCTCTCTTTGACAGATGGGAGCAGGAA
CATGGTTAGGGAGGCCAACATGGTTTAAAGTCCCCCACCGATGGGAGCCCTGAGCCA
TCTAGGGGAGGCTATGGGAGGTTGAAGTGCCTCTCTGGGACTCAGCTG (SEQ ID NO:
50)

eHGT_407m (329)
CCACATTCTTTGCTCTCACCTCCTGACCTTTCGACCAGGAAAGAGAGCCACCAGTTGC
TGGTGCTCCCTCCCACACCTAGTTAGCTGGGTCCTGGAGGCATCTTCCCAGCGGGGC
ATCTCTGAGCTTGGTGGCTCTGCACTGGCAGTGGGCCCTGCTCAGCAAAGAAAGAAC
AATATGGACTCTGTTCTCAATTAGTGTGTAACCCTCGGGGCAGGCACAGGCTCACTCC
TGCTCCCCTGTACTTTAATGGCCTAGTCTGATGTTCCTACAGCTCGGGGCCAGGTGGG
GCAAGAGCCCAGAAACAGGAGAGCACCTTGCATTCCCTGGA (SEQ ID NO: 51)

| FIG. 25 cont'd |
| --- |
| Enhancer Name (Length) & Enhancer_Sequence |
| eHGT_408m (672)<br>TCGGACTTTGCTTACCGTGTCTTCTCATGCTAGATTAGCTGTTAGTAACACACACTAGT<br>TGTCTCCAAGACCAGATGGACAGGAAAACCTTGAATTACCACCTTCATGTAATTCCACG<br>CCAGATATCTCAGCAGACACATACACACACACAAACCTCTTATTGCTCCCCTGAAAGG<br>GCATCTGAGAGTAGGGCTCCTGAAAATGTGTGCAGCCTGTGATAATGGGGCACACAGT<br>AGACAAAAGGGCAGAAGAAAAATGAGGCTTTAATAGGCACACTATCTAGGTCATTTATC<br>CTTGGATAATGGGAAAAAAACACAATGTCGTAGTGTCAGCAAGGGACACAAAGGCATT<br>CTGGTGTCCTGCAGACCAGAGCTTGATATCAAGAGCCAGTGTGTGGAAAAACCCACGT<br>GGAACTAAAATGGACCCATTTAAGTGTGTGTGTGTGTGTGTGTGCGCACGCATGCG<br>TGCACATTCACGAGCATGAACTCACATTCACCCAGTCTCAAGGACTACTAGATTATTAA<br>ATCCTTTATTTGTTTTCTACAATAAGGTTTAAATTATAAGACCTTTTTCTATGTCATTTCA<br>GCAAACCCTATTTCCATCTAAGAAAGGAGTGATATACATGGAATTGTGCTTGTCTTTTAC<br>CTTCCCATACCCCCTTTACACACCA (SEQ ID NO: 52) |
| eHGT_411m (358)<br>ATCTTTTGAAAAAGGAAGAAAGAAGCTTTTGGGTTCTTTAGGAACCAGACTCAGGGCA<br>GTAGTGGCTGTGATTATCAGAGACACCTCCCCGACCCCCAATTCTAGAGTCCCCTCCT<br>CCCAGAGTGGCATTAGCTTCTGTCCCATGACTACTATCTGGCTTCCCCTTTCTCTTGCA<br>CCCAGGGTGCTACAGGGCGTGACATACAGTGGGGGGTGGGCAGGGGGGGAGGTTT<br>CCTGCATCTGGCTCTTGCCTAAGGGCTCCAACCTCAGGTTCCTCCTTCTCCAGTTCTC<br>GATCAGGCTCCCACTGGGGACTAAAATAGTCCCAACCTCCTCTCCCATGATCTCCCCT<br>CTGTCCTGGCT (SEQ ID NO: 53) |
| eHGT_412m (402)<br>CAGTGTCCACCTCTGCCACAAGAGTACAGCTTAAGCCTCAGCAGAGCCAGTCCGAGC<br>AATTAAAGGGGCAGGGCCCTCACAGCCAGAGGGTGGGCCGGAAAGGCTGGGAGATA<br>GCAGTTCTGAGGAAGCAAACCCACCCTCTCTCTCTTTCCACATCACGCGGACCTGGCT<br>GACGTGGCCCAGGAAGAGGGGACAACCCGGGCCCTGTGGTTGAAATTCTATTTATACT<br>GACTGTTGCAAGCCTTTCCTGCTGGCGACAAGGACGTCACTGGGCACTGACCTCACCA<br>GAATCGCTGACGCATCTTCCCTCACGCTTTGCCTGGATGGTAGTGAGGCAGGCCTCTC<br>ATCCTCTGGGCCACTCCCACTGTCCCTCTGCGTACAGTACCCTCCACTCCTGTCCCC<br>(SEQ ID NO: 54) |
| eHGT_422m (619)<br>AAACGCATTTGTGGGAGGGGGAGGCACAAATATCCCACTGAGGAGAGAGTAGTTTCA<br>GGGTTCCAGAGGTTCAAAGGGGCTCCAAGGAGCTCCGAGGGGCTGCAGGGCAGAAA<br>GCAGAACTAAGGACCGGTCCGTGAAGGTCCTCTTCCCAGGAGGAAACTGTAGCCCCA<br>CAATGCCTAGCCTCACAGGAAACCACGTGATGGAAAAAACACAAAACTCCTTCTGGGG<br>AGAGAGTGAGAAGTGAGGTTGTGAGGTTTCTTCAGCTCGGGGGGTGGGGGGGAGAG<br>CATTTTCCAACCGCAAGGATTGGGGGGGGGTGGAGTGGGGCTCAGTCCTCTTGGTC<br>CTTCTCAACTCTGTCCAGAGGACACCATAGCTCAAGGCCTTCAGAGGTTCCTACCCCA<br>ACCCAGGCCTCCTGGGCCATCCTAGCCCACCTCAGGAACAGGCCAGAGACCCCAAGC<br>AATGTGAGGGGGCTCAGCTCCTTCCCTCAGGGACAGGATGAGGAAGTCTCCATGCAA<br>ATGTGAACAGACCACAGGCAGAGAGTTCACTATTGAGGGGACAAATGCAAATTTCCCA<br>GAAGAGGAGGGGCAAAGAGAGGAGCCATTGGGTCATGGCTTCCACACA (SEQ ID NO:<br>55) |

| FIG. 25 cont'd |
| --- |
| Enhancer Name (Length) & Enhancer_Sequence |
| eHGT_424m (397)<br>AGTGTGGCAGAGTGTGTGGCCTGGGGGAGAGCAGAAGGCTTGGAGGAAGGGATATG<br>CAGACACCCAGCAGGGCAGGGCTGGATTATGGACTTTGTGATGACAGCAGATTGAAAA<br>GAGAGAGCTCTGGTGTCTTGAAAAGAGGAACTGCTCTATTTGGGTAGCTTCCTGGGTG<br>TAAGGGAAAAGCAATGTCAAAAGTTCAGGCCTGGGGCGCCTTCCAGACCCAATGCCA<br>CTAACAGGGATAGGGCGGGGTGGCAGGAAGGAGACAGACTTGAGCGTGCTCTGCCT<br>CAGTGGACTATACAATCTGTTTCCTTCACACATGCACAAAGACTGATGGGAAATCGAGT<br>GTTCACACATAGAACGCCACCGGCCTAACCAGCCCTGGGAGGGCACACAGGTC (SEQ<br>ID NO: 56) |
| eHGT_425m (306)<br>TGGCAAGGGTCAGACAGAGCTACAGGTTGGAACACACCAGCTACCTTCACACCTGAG<br>CCCTAGCATGGCTCACACTGGGGGTGCAAGGACACTCTCTTCCTCAACCTCCTGCTGG<br>TAAGCTAAGCCTGCTTCCTCTTCTCTTGCTCACAGCCAAGCAGTCCAAACCACAATGGT<br>GTCACTGTCAGCTATGACATCACAAAGTACCGTGGTGGAAAAGATGTGTGTAGGTAT<br>CAGAGTGGTAGGTCCCAGAGCTGCAGAGCCCCTGTCCTACATAAGAGGTGGGTCCCA<br>AACCCCAAAGCCCCTGC (SEQ ID NO: 57) |
| eHGT_426m (354)<br>TGGAGTGGTCATGTCCTCTTTTTATATAAGTAAAAATTATTCTTCTCAACAGATAATTTG<br>CATTGTTTAGGGCTTCAGAATAGGGAAGTAGTTATGCTAAAATCAGAAGAGTGAAAGAG<br>CCAAGCAGGCTGAGAGCCCCCTTGAAACCCCCCACCCCATGCTATGCCTCCTCTGAG<br>GAAGCAGCAGAAAGCCCAGCAAAATTTCAGGTTCCTCCTTTGGGGAAAAGAGAAGTTG<br>ACCTCAGTAGTTTCTCTTGAAAGTTACTTATGTTGTGCTGCAGCTTGCATCACTCTGGA<br>TACAGGATGGAGTTCTTTCAGTCTTGGAGTTCTTTCAGTCTTGGAGTTCTTTCTGTTCTC<br>T (SEQ ID NO: 58) |
| eHGT_427m (393)<br>CTGGAGCCATTGGGGAAGGGCAAGCCTGGGAGCCAGGAAGCCACCTGCCCAGGGCA<br>TGTGAGATGGCCTCTTCAGTCCCCCCCACCCCGCCCCCCTCCCGCCAATACCCAGCC<br>TTGTCGCTGGTTTCCTGTCAGTCTGCACTCCCCAGGGAGGGGAGGGGTGGCTAATCT<br>CTGATGCGTTGTGGAGGCGGGCTCCAAGACCGTTGGGCGCCCTGAGATCCGACCCAC<br>GTGGCCTCGGGGGTTATAAGCCCTACCCACCCTGAAGGGAACCCCACTTTGGATCCAG<br>CTCTTCTCAGCTCTGCAGCATCAGGTAAGACCTAAATCTTCACTCTGGCCTCAACCAGG<br>GCTCTTTAATTCTGGGCCCAAGGCTCAGAGAAGAGCTTGGGGTGCAGGTT (SEQ ID<br>NO: 59) |
| eHGT_371h (292)<br>CTCCCTGCTCCCCAACCGCAGCCTGAGGTGTGAGAATTCTAGATAGGGCCACGACAG<br>TGTGAGCACATGAAAGATTACCAGGAAGAGGTTGAAACCTGGCTCCTGGGAGAGAGA<br>GGGGTGTGAGGCCTTGGCAGGAAGCCCAGTGCTTGGCTGCCCTGGTTTCCTGGGGC<br>CCAGGCATGCGTGGTCACAGTCCACAGCCTAGGGCTGGGCCAGGAGGACATGCCTG<br>CCAGAGTCCCGAGGGTGAGGGGAAGGAAGGGACAGGAGGCGCTCAGCTGGGGCAG<br>GGAGAAACCAA (SEQ ID NO: 60) |
| eHGT_372h (263)<br>GAACTGAACATGATGTGAGATGTGTAACTTTCATTTATTCACTCATGTGCCAGGCACCA<br>TGCTGACATTACATGTGAAAAGTTTCCAAGGTTTTCTTGTTACGTCTACAATTACTGCTA<br>AGTTTCCCGTAAGTAATTTGGGGGACTGGAAACGAGGGCAAAATTACATGAAGGGCTT<br>AGAAAACTGCATCAATTCTTTTTGGATGTGTCAGGGAGATGGGGGTAGTCTTTCTCCCT<br>GCTAATCAAGACCCACTAGAGCACCGC (SEQ ID NO: 61) |

FIG. 25 cont'd

Enhancer Name (Length) & Enhancer_Sequence

| eHGT_375h (327) |
|---|
| GGCCACGTTTTGCCTAGGGAAGATGAAGTCTTTGATGATAGCCAACTTAGTGTCAATAA GTGGCTTTCTTTGAGACATATTCAGATGGGAACGTCTTGCTTGCCAATTGCCATAGAAA TCTTAACACACCATGAAGATTGTCCGAGCGCCAAGCCTTCCGTTCTGGACTAAATTACT TTGAAGTGGCGCAGTACGAGCAGTGGTCAATTTTAACTCTATAGACTGGACAGAGAAT GCTGGGAGTGGGAGATTGTGCGTTTTAAAGCAGAAAATAAGAAGGGGAAACTTGTTTT ATACACTCTATACAAGGTTCTGCTCATTGTCAGA (SEQ ID NO: 62) |

| eHGT_376h (555) |
|---|
| GGGGCCATTGAGATTGCTGGATCCTGATTCTTTGAAGCATTTCATTCATTATGGTAAAG AAGGGTTTAAGTGGCCACCAACAGAGAGACGTGAAGTACATGAAACAATTAGGTTCTC TGTATCTCCAGCAGAATTGGCCCCAGAAGAGGGTCAGGCTTTGCAAAGACACAGAACA TTTTTCCCGCTGGGCTCCTTGGGAAAAGGTCTCAGCATTATGGAGGGTGTCTCTGGCT ATTCACAGCTTGCCAGTGGGAACAGCCAAGAAGGAGAAGAGGTCACATGGCCAGGCC TGCTGCCGGCACAGAATGTTCTGTGCAGCTGATGGCTGGGCAGGGATGAGGTTTGCC CGATCCCCTGCTGAGGCTTCCTATGAAAGGTAGGCCTGAGAGTTGCCAAAACATATTC TGCAACAGGGTCTATGAAGGTCACCATAAAGCAGGATTCAGACTCCATATTAGTTGGTT ATCTCTTCTATACAGAATGTTATGCCAAGCATTTCTATATATATTCCTTTTGTTTGTTTGT TTTTGTTTTTGTTTTGAGAGGGAGTCTTGC (SEQ ID NO: 63) |

| eHGT_377h (483) |
|---|
| GTTATCACAAAGCTTCTAGTCAACCTTAATTTCTACCACCTGAAATTCAGAACCTAAGG CTATTTTACAATCTTTACAAAATTTAAATTATTTTTCTCTTAAAAGCTGGGCAGGTTGGTG GGTTTTCTTGGTTTATTCTTCAGGTTTTTTGTTTTGGTTTGGTTTTTGGTTTTAGTCCTTG AGCTTTGTAAATAAGTTTTCCTGCGCCTGCTTGCCTGTAACTTATTTTTCTGGTCTAATG ACTGTTTTTTAATGAGTTCAGCCTGTGCTTTCTTGTACAAAAAGAAACGTGGGCATGTG AGGAGCATATTAATTAGCTATCAGATGTAGCCTGGTTTTTGAAGTCCAGATCTTCAGGA TGTTACCGAAGTGTAAATATAAGCATGACTTTTGCACGTGATTAGTAATTACATCACAGT TAAAGCCTCAGGGGACCTTCCACCCCAGAATTCTGCTATCCTCAACCCCTGAATGGCT CTGTCA (SEQ ID NO: 64) |

| eHGT_381h (232) |
|---|
| GGGCTTTCTAAACTGGCCTGGAACACTGTTAGTTAATAAACATTCCTTTCAGGGTTGTT CTCTTTGCTTCTGATCTCATTGATGATGATTTGTTGGACAAATAAGGAAGTAAACAGTG CAGAGTTTTTTGGCTTCTGCTCTATTAAAAACATAGCAGAGAAGGACAAGAAGTTCCTG CCTGCTAAATAGGAAGATCTAGGGAATCAAAAGAGTCTCTGTCAAGCTTCTTGTA (SEQ ID NO: 65) |

| eHGT_382h (515) |
|---|
| CTTTGTTTTCATGGCATATTATTGGGCAAAGATACTATTTATTCGATGCTATGTGTGAGC TGGGTCAGGATTATGACCCTGAGTTATGTTTCTGGGAAAATGTACCCACTTGTCAAAGA TGCCGTTGGCTCCTGTGATTAAGGTCAGCCCACAATGAATGTGGGGAGGGCTGGCAG CCTCTCAAATCAGCTCTTGACCATTTCTCAAGCTGGGGCCTGTTGTGCTTGGGGGAAG AGTCTTTGGCAGCTCAGCTCGGGGCTAGCGTTTCCTGACATTTGTTTCGCTGAATGTTA ACAAGGTTACTGGAAAAAAGGGTTCTCTCCTAAAATAGGTTTAGGGAAGCACTGGGAT ATGCGAAGTGAATGAGTTTCTTTAGGGCAGGATCTTGACTCTGCAGGGGGCTTGGAGG CCTTCCCTAGAGTGGGGCTTCCTAACACTGCAGAGCTCTTCCCAGGACGAGGGGCAA GATTGGGACCTACTTTGGAAGGTTGTTTTTGTTTCGGCACCTGCTCTGT (SEQ ID NO: 66) |

| FIG. 25 cont'd |
| --- |
| Enhancer Name (Length) & Enhancer_Sequence |
| eHGT_383h (372)<br>GAGAAGCCAGGCAGACAGCTGCCAAAGGGCAGGGGAGCCAGCAGAGCTTCTGAAAAT<br>ATCATGAGGCTTGGAAGACAAACACTGGAGTTCAGGCCAAGAGGAAATCAAGGGCTTG<br>GGGGACCAAGATCATGGAAAATAAAGAGGCATGGGGAAGTCAGCCTGACAGTCTCTG<br>GTACTCTCCATTAGACATTTGCCAATTCTTTATTGAGCAGTGTCAGGGGTTAAGAAGCT<br>AAGAAAAATTAGCTGAAAAGGAGAAGAGAGTTTTTGGCAGCCTCACAACACTGGGTAA<br>ACAAAAACTGGAATTCAGCACTGCCAAGGCAAAGAGGTCATAGTAAACACTCTAGTCTT<br>TTAGTCTTGGACCATTGGCAAGCT (SEQ ID NO: 67) |
| eHGT_384h (441)<br>GACGCAAAGCAGAGTAGCCAACAAAAACCACTTAACTAGGCCCACCTATACAGTATGA<br>CCAAGTTGAGGATAAGCCTCACTAAAATATTTCACCTGGCATGTGTTCAAGTTTTGAGG<br>TTGAATGAGTCTGCTTTTGTTTCTCACTAAGCCTGGAAGAAAGGGAACTTGTTAGGGAG<br>GAGGAGAGGAGAGAAGGGAGGAATGAGTTAAGTCCTTAGCATCTTTAGTGCTTTTTCT<br>TTGCTTCTTTTCAAACAAGCACACCACATTGAATAGCATGTGGAAAATTGGCATTTCCA<br>GTGAATAGAAATTAACTGGCAAACAACAAAAGGGAAAACAGAGGAATGCTGCTGGATG<br>CTGTTTGACTTGTCTCATCTTGTCAGAGAAGGAACACCTGTGAATCAAATGATTTAAGA<br>TGAATTTACCTACATGTTTGGTTCCTGTTCA (SEQ ID NO: 68) |
| eHGT_387h (520)<br>ACGCTTGGACTAAGTCGGTTAGGAATAGGAATGGATAAATAATGGGGCAATACAAAGA<br>TCCCTGGTCAACTTCACAGTCTGTCATCTAGGTGCTCCGGTTTTTAACATCTTCTGCAA<br>CCTTCGGGAAACAGAACAGATCATCGCAATCTACTGTTTTTTTTTTTTTTCCTCTAAGAA<br>AATGCCCATGGAAAAGTGCTGGATGTCTTGCAAATCTGTTATCGCAATGCAAAATCACA<br>CCGAGTTTCTTTAAGAATCACAGTGCATTCCCTCTCTCCCAGAACTAAATAAAGCCTGC<br>CTTGGGAAGCAATTCAAAACTGGAATTCTGCTTCTACATTGCTCAGTTACCCAGGCAGC<br>TGAAGCCTTTGAACAGGTCTCAGAAAGTCCCTCAAATACAGTCTTTTAGGTCAAATGA<br>GAACAGTCCTGTTAAGTCATACACTAATTCCTCTCTACAAACAGAAGTCTGGTTAATTCT<br>CAGGGAGCTAAGAAAAAAACAAAGATCCTCTTTCTTCCAGAAAAAT (SEQ ID NO: 69) |
| eHGT_388h (387)<br>ACTTGGAGATGTCCCAGGAAACAGAATAAAATGTTTCAATATGGTATCCTAGGAAAAGA<br>AGGTTTTTATCCCACCTTATAATTAAATCTGAAAGATTCCTACAGTGAACTAAGAGGTTT<br>CTAATGAAGTACTAAGCTGCATTTAGAATTGGAGCAATGAAAGGCTCTTTGTTCTCCTTT<br>CAAAAGGTTCCAGTACAGAACAATTTGGCTCCCAATACAGGCATGTTTTAGACCACCTG<br>CAGGCTCTAATCTACGCAAATTTATTTGGTACAAACTTTCTTCTACGTCACCTTCTTATT<br>CAGTATAATTCCAGAGAGGTTTATTGCTAACATTTAACAGTATTAATAAGAGAACAGTTG<br>CTCTCATGGGGACTGCCCTGGAAGGAAAA (SEQ ID NO: 70) |

FIG. 25 cont'd

Enhancer Name (Length) & Enhancer_Sequence eHGT_389h (733)
GGCTCAGGGCTCCATGACATGTGGCGACATGCATGAGCAGGGAGGCTCATGCCACCA
TGGAAGCAGGTGACCCTGGTGGCCCTGCCAGGACCCAGCCCCAAACCCCTTCCTGGG
CCTTTGGCTCCCAGGGTCTCCTCAATGCAGCAGGGCAGAGCCTGGGAATTGGACGCA
GCACAGCCCGGCTCAGAGCCAGCAAAGTTCACACTGTTCTTTGGGGAGAAAGGCGCT
CAGAAGAGATGCCTGGGCCCTTTGTCCTGTAGCTTGGTAACACAAAATTCTCACACTTG
TCAAAAAAAAAAGGGGGCTATCCAACACCCCGCCCTTCCTCCCGGGCCCCCTACCC
CCATGCAGTGACTAGAGCTGTGGTCAAGGACTCTTCTTCCCCAAGGCAGAGGAGGCA
CAGTGGGCTGCCAGATTGCCAACCCGGCCAGGACAAAAGGCCTTTGACAGCTCCCTG
CTGCGGTTCAGCAGTGACCCAGAGGCTGGCCCTGAGAGGACACGGCTCTGCCCAGTC
CCTGGAGAGTCCCCAGGTCTGCTAGTGAAGCCCTGCGGCCCTCAAGCCAGGATGACT
CTTTCCCTCTTGGCTGCAACCAAATTTCCAAGGGCCTGCATGTGCGCCCATCTGTCTA
CTGTCCACCGCAGAGGTGAAACGGGAACATGACCCCACCCGCCCCTCTGCACCCTGA
GGTCACATCCGACCAGCACAGTCGTGCCTCACCCTGCACCTGAGAC (SEQ ID NO: 71)

eHGT_390h (691)
CCCCAAGCAAGGTCAACAGCAGCTTCAATTACAAGACAAACTTAACAAGAGTTGCTATA
AACCAAGTACTCTGTATTGACTTAAGAACAGGCTCCACTCCACATATTGCCACTAGCAG
GATTGTACAGGAATGCATATTGTAAAATAAAGGAAGGGGTGAGCTTTTTTCTTTGCCAG
AATTTGCGAGTGCACAGCGACTCCTCATTCACCTCTCTCCAACCAGCTAGCCGCTCAG
CTCAATTCACCCCACACAAAGGCTGGAGCCTAGACCTCAATGGACCGAGTGAAACATG
TTCAAAACTAGGCTCTCTATTGTGACTGAATTTCTTAACATCTTTTCAAAAAGCGGAGAA
TGCCTTGAGGCTAAAGGAAGAAACAGGCTAATGGTGAATTGGGAATTCTGAGCAAATT
TCAGAGCCCTTTCCTCCTAGCTTTTGAGGTTGAAAGCAAGCTCTTTCCTTTCAAGTTTC
AAAGTCCTTTTTCCTCCCGCAGTGTCACAGAAGGATTTGAAAAGAAGGTAATTGTGCTC
GCAGTCTCCCTGATCAGAGCTTACGTCCTATTTCTGGTATTTCGGAATACTTCTTGCAA
TAATAGTGCATATAGCTCAATCCCTTAACCGGCCTGCACTCTGCAATTGCTCATTAAAT
GAACAATTGCGGGTATAAAATGCCTTTTATGTTCAAGGTCTGGA (SEQ ID NO: 72)

eHGT_392h (503)
ATTCATGAATTATCCAAAGAACTGGGAAATTTTTTGGTTGGGAGGTAAATCAGTTACAT
GAGCATACCGCTGGCAAAGGAGTATGCCATATGACTGATCTCTGTTGGGGGGCTTCTG
TCTGTTGACAGAGAAGCAGAAAAACAAAGGACAAAGGAAACCCTCATTAATTAATCTTA
CCAACTAAGCCAAATAAATGGACCACTTGTTTCAGCAACAGAAGCAAACTGTTGACAAT
TGAGAAAGCCACCTGCAGGTGCTTTTGAACACAAGCTGCCCCAGAGACCCAAAATAC
TATTGTCTAACACAGGGGTCAGCAAACTTTCTCTGTTAAGAGCCAGATAGTAAATATTTT
TGGCTTTGCAGGCCATATGGTCTCTGTTACAACTACTCAACTCTGCTGCTGTAGCCTGA
AAGTGGTCAAAGACAATATCTTATAAATTAATATGTAGGGTTATGTTCCAATAAACTTTA
TTTATGGACACTGAAACTGAATTTCTTTTCA (SEQ ID NO: 73)

eHGT_393h (518)
TGAGGCATAGACACACAGTGGAAAATCATTTCTCTTTTCAGTAAGTTTTGGGTCTGCTT
TAAATTGATCATTTGTTTCATCAGCTAATCCCCAAACAGAGGGCACGTCCGCTCTACTT
GCAAAATTCTTGTATGTAAGTTGAATTCTCCCTTTATCAACTCAGGCCAATAAGTACTTT
ATTTTGTTTTTGCTTGTTGTTAGGGAAAAAAAAAAAAAACAAAGATAATCAGCTCATACT
ACTTGCGTAGCTGTCTGCATTTTAATTCCAGACTATGAACGAGCGTCAGAGTGCCCTTA
TGATATTTTGCACAAAAGGCTCAGTGTTTATGACTCTACTCAGAGAACCCAAAATAGCA
TTGAGTAAGCAGTGACATACTGACAGTGTTGTGGTACTAAAAGCACAAGCGTCTGTAA
CTCTGGGCAATGGGGCACATCGAGAGTTTGCTGAGAAGACTGTGAAGCAAAAAGAAG
AAAGTTTTTCCTACTCTTCCTTATGTGTCCAACACGAAGTTTGCTGT (SEQ ID NO: 74)

| FIG. 25 cont'd |
|---|
| Enhancer Name (Length) & Enhancer_Sequence |
| eHGT_394h (511)<br>AGTTCAGCTCTTTAATTTNCCATTGGCTCTAACCAAGACAGAAGACTTTACTTAAGCAAT<br>TGGTTTGAAATTAGATGGACAAGCTGAAACAATGGGCTCTCTGTTCTTTCCTCTCTGTG<br>CCCACCAACTGGCATTCATTATTTAATCTGTGACGTGTGTTGCCAGGGCTGCGGTAAT<br>GACAACGGCACCTATTGTCTTCACATCCCTTCCCTATTCTGTAACATCTGTCATGGCTC<br>CTGTCTATATTTCATTTTATTTTGTTTTATTTTGCTTCTTTTACTTTTACAAGGTTATTCTT<br>AATTACTACAAATTGCTCTGAAATCTATTCTAACCCTGCAAAGTGTAGCATCATTTTGTA<br>ACTTGGCAATAACAATAAACTGAAGGCGCGTGTGATAGCACCCTTTTAAATTACTGTAA<br>TTTTACATAAAACTGTATAATTTCAAACAAATTTTATCTCAAGGTTAACTAGATAACCTCT<br>CTTTTTAAATACCTGATCAGTTCACAGACGACT (SEQ ID NO: 75) |
| eHGT_395h (624)<br>CTGGCCTTGGTCTCTCCTGGGCTAGAACAGGCCCCTTGTCTGCCTCCCTGAATCACTC<br>TTGAGGCTGGGCATGCACCTTCCCCCACTCCAGATGTGCTGACAGCAGAAATGCCAAC<br>CCCTCCCTTGAGGGCCAGTGAATTCAGCAGTGACAGGTCACTCTCTGAGCGAGACTG<br>GTTCTCCCTTCATCCGCTTGTAAAGGGAAAAACAGCCTCGGCCTCTGAGCCTGGCACC<br>ACCAGGTTTGGCCAGTCTTGGTTGTTTGCCTAAGTCCCAGTGCCTTCAGTTCCCATCC<br>CTCTTCTCTGACCCCCAACTCCTGAGCCCCTTGCCTGTCACCCTCCCCCACCCCAGCT<br>GCTGCATGTGCCAACCCCCCACCCAGGAGAAAACGAGGCTCTTGGAAGGGAATAAAT<br>GGAGGCTCTGTGCAGGCTTGCAGCTGAAATGGCCCTGTGCGCGGCCACAGATGGGC<br>CTCCTCTCCCCCTCCACATTTCTGCATCAACAAAGCGTGACCTTGTTTGGATGACAGTC<br>GCCCCATGTTTTCCCCATGACAATGCTTGCCTTGCCTTTGCCTCCCAGCGGGCTGTCT<br>CAGGACATCTCTGTTCCCTGAAATTGGGAAAGGGTGGTGGGGTGGAA (SEQ ID NO:<br>76) |
| eHGT_396h (340)<br>GTCTGCTTTCAGGCTGCTCAGCAAAACATCCCTAGACTCACCACCCAGAACAGAGTGT<br>AAAGTGGGCTTGCAGATAGATGAAGGGAACCATTGGTGAGGCTTGCTCTCCTATCTAT<br>TGCTCATATTCCTAGATCTTGAGCTCAGGCCCTGTGAAGAACAAGCCTGGGCTTTGTG<br>CATTGTGCCTGCTGCTGCTGCTGCAGGGACAGCTAGTGGGCATCTCTTCCGCCCT<br>CTGGCTCCGTCAAGCTCCCCGAGAAAAGGAACCATTGACTCTTACTGCCTTGGAACCT<br>AGTGGTACCATCCGAGTGGTAGAGAAAGTGCCAGGCAGGGTGAATGTGGA (SEQ ID<br>NO: 77) |
| eHGT_397h (424)<br>GGAGATTTGGTCCTGATTTTGAATGGTTTTTCTTGGTGGGCAGTGGTTGTCTGAGGCTT<br>TGAACTGATCTTTAACACACAGGAATGAGTTCTAGGCACTTCTGGAGTGGTCCAGAGC<br>ACCTCTAAATACGAAGCAGCAGATGAGGTCATGGTAATTCGGGGAGTCAGAAGTGGAA<br>GGGTGGGGGGTTGAAAGCTATAATCACTGTCAAAGGGGTGTTTTCTGTAGACAAGTGA<br>ATGGAGCTATTGTACACAAACTCAGTGGTTGCCAAGCATGTGGCCCAATTATTTTGCCT<br>TCATGAGCATGGCACGGAAGGATCTCTTTAGAGAACTTGATTCACACAAGTTTGTGTTT<br>AGTCTAACGGTAGCAGGCAAAAGCCTGGGGAATTTGAACCTAAGAGTCTTTACAAGTT<br>CCTGCCTCCCAAATC (SEQ ID NO: 78) |

| FIG. 25 cont'd |
| --- |
| Enhancer Name (Length) & Enhancer_Sequence | eHGT_398h (500)
GCTCCGGCCTCTCTATTCCCACTGCTCCATCCAGGAAAACCACGCCCAGCATGGCAAA
GCAAACCCTTCCTGGGGTCCCCCTCACTGGGGACACATCTGGGCAAGCCAAGGACAC
TCAGAACTCAGCCTGGCCAGGCTCGGTCCCCACCCCCGCTCTGGCCCTTCTCCCTAC
AGTGAAAGGGACTTTATGGGGACAAAAAGCCACCCATTGTATCACACGAGACAAAGGG
GCAGGGGACAGAGGCTCCGGGCGCCTAAGCTGGCCACGACACAGCCACACACCACC
CCCTGACTGTGTGAGAGGGAGGGCACCTTGGAATTCCCATGCCATGCATTCCAGCATT
CGAGGATCCTGGAGTCATCCCCGCTCTCCAGGAAGGCGACAGCAGACTCGGAACCCA
GCCCCAGATCCACTAGACCTGGGCAGTACTGAATAGCCCTAAGCTCTCTTTTCTCGTC
GGAAAAATGGGCATGTAAGTTGCCAAACGGAGTCATTCAGT (SEQ ID NO: 79)

eHGT_399h (282)
TCCCTGTCCGTGACATCACTTGAAAAGCCCAACAAAGCTCGCACTCGTTTAGATTTCAC
ATCTAGAATAGTATCTGTATAACCCACCTCCTGTAGATACCTGTGTGAAGAGAATCCTT
AGAGTTCAGTCATACTGGAATCAGTATTCTATAATTTAATATGTAAATAAAAGTATTTATT
TAAACTCATTGCCTGCATAAGACTTAACAGTACAGTACTATGCTAGTAAGACTTGTTAAT
AAATAATCTTCCAGCTGCAGATGGAGCTGTCTCTTGCAGTACC (SEQ ID NO: 80)

eHGT_400h (418)
GTGCTTATGTTGATTACTTCTTTCAGCTGAATAGGGAATAAGGCCTCAAAAGGTTTATAT
CCAGTATTTGAGTACTTTTGTTATTCTCTTTAAAAAGTCAGTATTAGGCACTACTGGTTA
CTACCAGCTGAAGCCTTACACAGCTGTGTATTTAGCATTTAATCATGCTAAGAATTGCT
AATTAGAAAATCAAACCGGACAAAGCATACCCAGTGGAGTTGATACAATACCATTTCTG
TTTGAGAACCATAAATAAATAATCTTTACGCATTAGTGTTTCATTATAAGCATTTGTGCT
GAATGTGGCAATATTTAACAAAATGTTTTAACTCACTAGAAATAATTTCTTGATATTATCC
TTTCACAGAAATCCGTAATCTCTTTAAAATATAGCCAGCCTTATCAAAATTAAGTTTCA
(SEQ ID NO: 81)

eHGT_402h (385)
GGCAGCTCAGCAGTGGGTTAGCTGGGGCCTGCACACAGTAGGTGCTCAGTAAGTGCT
TGCTGAGTGTTACTGGTGTTTTGTTCATTCTTTCTCTTCATCCTGCCCCACCCTGCCCT
GGCTGCTCTTTGCTCATTGTATGATCCTTTTCATGAGAGAGTGTTTTGAAGAGCGCAGA
CAGAATCTTAACAAATAGCGCATTGTCCCAGCGATCCAAAGCAGGACTGCAGTGCCGG
GGTGGCCCAAGGCTGCGGGGAAGAGGCTGGAGAGAGCAAGGCCTGCCGGACAGTG
GCAGATCTCTAAGGAAATTGTCCCCTGGGGGGTTGTGGTTCTTCCCATCAGAATCAGGC
CTTTTGTTCTCAGGAATGAGGTGGGCTAAGAGAGAGTTG (SEQ ID NO: 82)

eHGT_404h (405)
GAAGACAGACAGCTGAGGTAGGATACAAAAGAGCTATTGATGGCTTTTGTCTATGTCA
GACAGAAGCCTAAGGGAAGGGTGACTGCTCTCGCCTGGTGTCATGGATGTCACATGA
TAGAAAGTTTTATGTTTGTTTCTGACATTAGGCAAACAAAAACCTTTTGAGGGCTGAATT
AGGCTTTTGTTTTGAGCCTGCAAGCTGCTACTCATTCCTATTGATGAGTACTGATCTGA
TTTCAGCCTTTTCATTTTTATGGTGTTAACTGTGTGGGGAATGTGTGTAGAAGGCCGGA
CACAGGACCACCGACCCCATCTCCCTTGAGTTCACATATCTTTTGGAATTTCCTTTTTTT
TTCTTTTCTTTTTTTTGTTTCGTTTCAGGAGGGGGGCTGTCTCAGGAGCTTCG (SEQ ID
NO: 83)

| FIG. 25 cont'd |
|---|
| Enhancer Name (Length) & Enhancer_Sequence |
| eHGT_405h (392)<br>TTGGTGTTGTCCTCTGGCCCAGCCCTGCCCAGGAACAGGAGACAGACGGCCACACAG<br>AGCCTTGCCTCTGATAACTGGGGGGTGGAGAGGTTGAGAAACAACGCTTCACTCAGC<br>AACTTCCTGCTCCCTCCGAGGAAGAAGAAAGGGGTGTCTGTGCTAGAGCCACTCCCTT<br>GCCAGCAGCCCAGCAGAACAGCTGCTGATCCCCTGCATCCCCACGTCCCGGCGGAG<br>GCCCTGGGAAGTGGGAACATCAGCTGGAGAGAAAAGGAGAAAGCAGTACATTGAGTG<br>TTGCTTAGGCCGCCTGCTTCGCTTTCTTCTCTCGCTCTCCCCAGAGACAATCTCGTGG<br>CCTGTGTTTCCCCGCAGGCAGGCCCCAGCGCCCTCAAGCCCAGATGTCT (SEQ ID NO:<br>84) |
| eHGT_406h (354)<br>ACCTGGACCAAATCTGCTGATTCAGTGCTCTGGGCTCTCTCCACTTCATCACCCTCATT<br>GGCAAGTAGTCGACTGGGCGGGTTGTTCAAAGCGTGCCCTCCTCAGCTTCTAGACCCT<br>CCCATTCATGCCATGTCCAGATGACATCTCCCTGAACACAATGCTCCCTCTCAGACACA<br>TTTGGATGGAATTATGCCTGGCCTGAATGGGAACCTTGTCTGCTTTCTAGGTTTCTCCC<br>AGACAGGGGTAATGTTTCTAGAGTCCATTTACTAGGAGCAGCATGATGGGACTGGGGA<br>TGTCCCTTTAAAAATTAAAAGTTAAGTTTCTCTTTAAGTGCCAGGATTGAGTGGATTTGG<br>G (SEQ ID NO: 85) |
| eHGT_407h (264)<br>TACTGCTTTGCTCCCCAGCCCAGGTGTCACCACCCAGTCAATCAGAAAGTCAAAGAGT<br>CTGAGGGCAGTGGAGGGAGGTTGTGCCTGGCCCAGAGGGTTTTAAGTGTGAACTGGA<br>TTGAGAACAACATGCCGATTGTTCTTTGTTTGCTGAGACTGGCTTGGTGCCAGCGCAG<br>AACTGGCTGGCCCTGAGAAGCTTACAGAGCCTAGTGACCAGGTGTGGGGAACCAGCA<br>CTGGCTGCGGGGGTGGGGGTAGAAGGGAGCACAG (SEQ ID NO: 86) |
| eHGT_408h (604)<br>AGCTTTTGGTAAGACACTAAACTGTCTCGAAGACTAGACAGGAAGGAAAACCTTGAATT<br>ACTCTCACATAATTCCACTCCAGATATCTCAACAGCAATGCATACAAAAAGCTCCTATTA<br>CTCCCTCAAAAGGGCATCTGAGACCGAGAATACTTAGAAATGTGTGCAGCGTGTGATA<br>ATGTGGTACACTGAAGAACAAAAGGGCAAAAGAAAAATGAGGCTTTAACAGGCACAAT<br>ATCTAGGTCATTTATCCTTGGTTAATGGGTAGAAAAACACAATGCGGTAGTGTCAGCAA<br>GGGACACAAAGGCACTCTGGTGTCCTGCAGACCAGCGCTCGATGCCAGAAACCAGGG<br>TGTGGAAAAACCCATGTGGAATTGAAACAGACCCACTTAAGCACGCACGCGCGCACG<br>CACGGTCTCAGGAGCTACTGATTTGTGGACCCCTTTTTGACCTTTGGTATTTAAAGTAA<br>AATATAATTTGAGATCTACTGTTTTCACCTTTTTATGTCACCTGAACCAACACAAAGCCA<br>TATTTCCATCCAGTTAAAAAGCAGGGGAAGGGATGTGGACGAGAGTGTTTCGTGTGTG<br>TTGCCTTCCTCCACACCCT (SEQ ID NO: 87) |
| eHGT_411h (389)<br>GAGACGGGGACTTCTAGCCCCCAGCTGGAGCCTGGGGCTGGGGAAGGAGGAACCTG<br>AGGTTAGGGTGCTGGAGGATGAGACAGCTGCAGGAAGCCCCCCTCCCCCATCCACAC<br>GTCACACCCACCGCTCCTTGGGCCTGGGCTTAGGAGAAAAAGGGGAAACTGGATTC<br>TGGTCACAGGGCAGATGCCCAGTGGCCTGTGGGGGAAGGGAGGAGAGGAGATTTGG<br>AGCCTGGAGGAGGGTCAGGTCCCAGCTCAGCCCACGGTCACCACTGTTCAGGCCTGG<br>CTGAGTCCCCTCCCTTAAAAACCCAAGCCTCTCCCATTGTGTCTAGAGCGAGCATGGA<br>GGGAACAGACCCTGTAGGTCCTCCCGGGCACACCAGGCCACCCAATGT (SEQ ID NO:<br>88) |

| FIG. 25 cont'd |
| --- |
| Enhancer Name (Length) & Enhancer_Sequence |
| eHGT_412h (440)<br>GAAGGCATAGCTGGAGGGCACAGGGGCTGGGGCCACTGTCGGAGCATCCAGAGTGA<br>AGTGATACACAGGAGGACAGGGAGTGGCTCGGAGGTGAGGAGGCCTGGCCGCTGAC<br>CATCCCAGCCAAGCGTGAGGAAAGATGCGTCAGCGTTTCTGGTGAGGTCAGCAATCA<br>GTGACGTCCCTCTCACCAGCAGGAAAAGCTTGCAACATGGCCCAGCCAGTATAAATAG<br>GCTCCCCGACCACAGGACCCGGGCTGTCCCCTCTTCCCGGGCCACGTCAGCCAGGC<br>CCGCGTGATTTGGAGAGGAAGAGAGGACCAGCTTGGTTCCTCAGAACTGCTGCTTCCT<br>CGCTTTCCGGCTTACCCTCTGCTGTGGGGCCCTACGCCTTTAAATGCAAGGATAGGAC<br>CTGAGATGGCCTGGCAGGGCCAGGTCGAAACTGGAGGCTGG (SEQ ID NO: 89) |
| eHGT_413h (692)<br>CCAGGCTGGTCCTTCCTGTCTCACTGAGGTCTCAGACCTCATGCTCATTGGGACTTGG<br>CTGAACTCCAGGCCGTCAGCCCAACAGCGCTAAAGCTACAGCCAAGCCGCAGAGAGC<br>CGTGGCCTCCCACGCCCCACGTTGCTGGGCAGAGAAGGGAAGCATTTCAGACAGGCA<br>GGCTGGCCCCTGGCCAGCAGGTCTCCAGATGCCATGCAACACACACCTGAGCAGGGT<br>AAGAGAATAGGTGTGTGTCAACAGTATTTGAAAAAGAAAATAGCTGCACAAATACAGCA<br>CTTGTTAACACAGGTGTTTACAGGTGGAATTATTTTTCCAGGGCTGCTATCTCCCAGCC<br>TTCTTTGTGCTTCTCAGCTCACACCTGCAGGGACTTTCCTACGAAGCCAAGGCACAAA<br>GGGGAAGTGGATAGTCCGTATCAATTTTACCACGGAGGAGGTCAGCGATCGGCTTCA<br>GGCCTGGCTAGTTTTCACAGTTTCCCTTGCTGGACTCACTTCCATGTTTTCAACCTGCT<br>CTAACAGGATCTGGCCTGCGCTCCACTTCCTGCTTGGCTAAGGCAGCTGCTGTGACCA<br>CCCCAGGCAGTCACAGCAAGAAGCCATTTCCTGGGGCCAGGGCACGCTGGCTACTCT<br>CGGGACATAATTATCTATCTGGTCCTTGTCTCCTCTCCCCCAGGAGAGGCTCAATG<br>(SEQ ID NO: 90) |
| eHGT_414h (433)<br>GCCATCACTACTGCCAGGCAGCAGCCAGCCCACCAGAGCCTGGCCCTGGTGGCAACC<br>AGTTAGCCTCTGTGACCTCCCCATCTGACTCCATCTTCCCCCTCTGCTGTGGACCTTGT<br>CTAATTTCTACCCACTTCAGAGACTAGGACAAAGATGGCATCTCCAAGGCATTCTCTTC<br>TCCAAGCTGAAGACCCCTGTGTCTGGGAGGGGCTGGGAGGTGAGGTGGGGCCTTCCT<br>GGAGGATACTAAAAGGGCTCCTAACCCTGGTGTCTCTTCCCTCCCAGCCTGTCCCTCT<br>TATGCCACTCATGGCATCAATCCGTCCAGAGGGACACTCCGATGACTCACCCACCACA<br>GCACTTTCACTTCCTTCTTCTCCAGAGGAGGCGTCTGACCTGCTGCAGCTGCACTGAA<br>GGGCCTCTTCTCAGGGGCTTCCAAGGC (SEQ ID NO: 91) |
| eHGT_417h (356)<br>GTGGGATGCCTCCATGAGCTCCAACAGGCAGCCTCGCCGACCTCCCAGCTCTGCTCA<br>GTTGCTCAGCACCCCATGGAGAAGGTGAAGCCCATAATGAACACACTGCCCTGGCCA<br>CTTACTTCCTCCAACCAAAGAAGCCCTCATCTCCCGGGCCTAGACCATTTCCGGAGAC<br>CAGCTTGTGACAGAGCCACAACCTCCGGTCACTCTGTCAGCTATCTGCAGTTCCTCCT<br>TTTTCCTTTCCTCTCTCCCCTCATAAACAATGACTGTTGATGTTTCCACTAGCTACAGAT<br>GCTGATGCCAAGATTAGCTTTGGTCAAGATGATATTCTCCATCCTCCAAAACAATGACC<br>AAAATGT (SEQ ID NO: 92) |

FIG. 25 cont'd

Enhancer Name (Length) & Enhancer_Sequence eHGT_418h (433)
AGCAACATTCTGTGTGAAAAGCCATGATGACAAATGAATGAGGTATATCCTAGGGTTAT
CAGTGAAAATCATCATAGTTTGCACTGTCAGCCTGAGTGTGCAGAGGTCCACAGCAGG
ACTGCCCCACACAGGAAGAAGACACAGAGAGGAATCTCTTACTACTTGCTTGCCTAAT
CATTTCCACTTAACACACAGTGAAAGCAGAACTTCGTGACATGCTTGCCCTGTCTGGG
CAAAGGTTCTGCTTTTTTAGGAAGATCTTGGAAAAAGAAAAAAAAAAACAAATAACAAAA
AGTCCCCCAAAACTTGGCCATGAGTGGGGAAGAGCTTCTCAATCTTTCATTTATTCCAC
TAGCATCTGTAGTCAGTTTCTTCATCCTCGTGCCATGTATCCACGTGCCTGGCACTGTG
CTGGGGACTGAGACCTGCGTAC (SEQ ID NO: 93)

eHGT_419h (560)
TCATTTCCAGGGGCCACAGCCAAGCCCAGAGTCCCCCAGCGGCTCGCATGTCAGCCC
AGACCCCAGGGTCCTTGGCCTAGGAGAGGAGCAGTGGAGGGGCCCAGGCTCTGAGC
TCCACAGGTCTGAGCAGGGAGCAACTCAGGCCCCCACCCAAGCCTGCGTCAGCGGAA
CTTGAGTGAGGGGCGTTGTGCAATTTGTGGCAAGGCTGGCCCAGCTGGATGCCTGGG
TCCCAGTATTTTTAGCCCCAAAGGAGAAGTGAAAAGGCCCCAGCCGGGGTGAATCATC
AGTCCTGGGGAAGAACCCAGGCGCCTGAGCCCCAGCTCCGGGAAGCAGGCACTGGG
GAGGGGGCTTCAAGGAGGGAGTGCCCCCTCAGACTCCCTGCTTCCCTGGAAGCTTCA
GGAAGCTCAGCCTCAGCCTTCAGGCCTGAGCAAGTGCAGGGCGGAGCTACCAGCCCA
GGCTCAGATGTTGGGGTGTGAAAGCCTCAAGTGACTCAGCCTGGTTGGAGAACTGCC
CCACCCAGTATCTTCTGTGCCATGGTTCCCACATTCGCACTCCATGGC (SEQ ID NO:
94)

eHGT_420h (469)
AGTTGCTGAGCCCAGTCTGGGTGGTGCTCCTCCCAGGCTCCCGGAAGCCCCACTCCA
TAGGTGCAGGCTTACAGACTTCCCTAACAACTGCTGCAGGCCACAACCTCAAACTCAC
AGCAAACAGGAAGCAGGAGGTGCTGTCACATGTAACACAGTCAGAGCTTCAAGCCCC
CGGAAAAGCTCAATGCCAGATTTCATTCTCTGCCCCTGATGATGCCCCGCACTTTCTTA
ACTATGCAGCTCAGAATCTCTCTGTTTCTCACGCAGAGACCAAGGACACCATCTGCCC
TACACTCACCCCAGGAAAGCATTGTTGGTAACATTCCTGAAATTTAGTCATCCAACCTC
TGCTAGACTATTTCTAGAAGGCAGCAAACCCAGCAGGCCTTCAGGGACAATGTGGACA
GAGTCTGCTCCCTCTTTCACATCTCATTTGTCTCCTCTTCTGCAAGCTAAACTACCCTG
GCT (SEQ ID NO: 95)

eHGT_423h (379)
CTGAGCTCCAGGAAGGCCACAGCTCTTAGGCGCATGACCCACACCAGGAGGTTTCAG
TCTAGACAGGAGCTGGGAAGAACTTAAGCCCCTGGGCCAATCAGCAGGGGAGGAGGC
CCAGCCTGTGGTTCCAAACACCAGGTCTTACTCAGTGTCCCCAACCACAAGCCACAGG
TGAGTCAGCATGCCACTTCCCGAGCTGGGTCCCACTCCACGCCCTCACTTCTGTTCTT
AGAAAAGGACGACCAGGCAATCTTGTAAAACCTTTGCTTCCCATTACTCGGCCCACAC
AGTCACCTGTGTGGCCTCTTTAGCTACATGAATCTTGCTCACCACCTTCAGCTTTTCAT
GCCAGCCAGCTGCCTGCCCCTTACACGTTCCT (SEQ ID NO: 96)

eHGT_424h (419)
CAGAGGCTTGGAGGAAGGGGCCTGCAGCTACCCAGCAGGGCAGGGCTGGGGTATGG
ACTTTGTGGTGACAGCAGATTAGTAAGCAAGAGATGGCCGTGATGCCTTGAAAAGAGG
AACTCTTCAGTTTGGGCAGCTTCCTGGGTGTACGAGGAAAAGGAAGTGTCAAAAGTTC
AGGCCTGAGGCACCCTTCCAGGCCCACTAGATGCCAGCATGGCTTAGGGAGGGCTGA
CAGCGAGGCCTGGGGGCTGGTTGGAAGGAGGCAGGTTTGGAGGTGCTGAGCGGGCA
GAAGACACAATCGGATTCATTCATTCACCAGCAAATGTTTCCTGAGGAAGACACAGGA
AGTCTTGTGTTTACACATTCACCTTCCTTGATCTGGCACAGACAAATCAGCACTCGCTG
AGACAGCATCTGCCCCA (SEQ ID NO: 97)

FIG. 25 cont'd

Enhancer Name (Length) & Enhancer_Sequence eHGT_425h (315)
GGGCCTTGATCACCTCTGCTGAGTAGCTGACTGCGGGGCTGGGGCTCTGATGCTCAG
GACCCACCTCTCTGGGACCCACAGTCTTTTTCCACTGTGGCGTGTAGTGATGTCACAG
GTGGCAGTGATGTCACTGTGGTTTGAGGTACTTGGCTGTGAGCCCCGGAGGAGGAAG
TGTCTGTTCGCTGATGGGGGGTTGGAAGAGATCATTGACTTCTGCCCCAAGCGTGAGC
CCCAAGTGTGCAGGGGGGGAGTGCGGGGGGGAGGGCTGTTGGCGGCGCATCCCAGGG
CTCTGGCTCTGCCCTTGCATCTAGCCTGTC (SEQ ID NO: 98)

eHGT_426h (443)
GCTGACAGCCTAGCCAGGTAAGTCTTGATGGGGAATAAGAGGGAAGAACCCTGAAGC
CACCCTGGCTGATGAGTGGCCAGAGGAATGCAAGCTACAAGACAAGGTTTGTAACCTC
AAAAAGAACTACTGAGGTCAACTTCTCCTTTCTCCAAAGTTGGCTGGGCTTTTGGCTGC
TTCAGAGGAGGTGACTCAGGGGAACTCCCACCCCTGGTGTGTTCTTTAGTTTCTCGAA
ACTTATCATGGCTACTTCCCTATTCCAAAGCCCCGACCAGAGCAAATTATCTGTAGGGG
AGAACGATCTTCAATAGTGACACGAGAGTAACACAAAGGGGAGCAGGAAAATATGCAC
GAGAAGCCACCTGCATGCCCTCCGGTCGTCCCCCTTGGTCCCATGGGGCCAAGCCTT
GGTGGTCAGAACACACAACGAAGGAAAGTCGCCCAGA (SEQ ID NO: 99)

eHGT_427h (345)
CCTCCACCCAGACCAGCAGCCCAAGCCCCTAGAGGCCCCGAGCTGAGGAGCCCCAG
TTGGGGCAGCAGTGAAGGTCCGGATCCTTACCTGAGGCTGCAGGGCGGAGGAGAGC
TCGCCCTGTGCTCCAGGCTCCGAAGTGGGGTTCCCTTCAGGGAGGGCAGGGCTTATA
ACCCCGAGGCCACGTGGGCCAGATCTCAGGGCGCCCAACGGTCTCAGAGCGCGCCC
CGCCCCCGCCCGCAGGGGATGAGCGCCCTCCCTCCCTCCCTCCCTGGGGAGGACAG
ACTGACAGGAAACAGAAGGGGGTGGGCCCGCGGGAGGGCTGGGGACCCTCTCTCAT
GCCCTGGG (SEQ ID NO: 100)

eHGT_428h (232)
CCTTGCATCTTTTAGCCGACCCATATGACTTACTCATTTTGTTTACTTCTTACTACTTCTC
CAATTTTTATTTTGATTCTAATCTGGTCATTGAGAATGTGACTTCCTCTTCTTAGTTTTCG
TTTCCCAGCTAGGTTTCATTTGCTGTGTCAGTGACTGTTTTTTTTTTTCTGGTAGTATTA
GTCATTGATAAAAAATGTTCTATAAGAAGATCGAGTCCAGGACCATACCT (SEQ ID NO:
101)

eHGT_429h (471)
AGCAGCAGCAGCAGGACACAGTCAAAGGGAAGATGTGAAAACATGGAGCTTGCAGAA
GAAAAGTCAGAGGACACCTCTGTTAGGCACAGTTTTAACTCTCCAAATGGACTGGGTA
CTTCTTCCAACTGTCTACTCCACAATCACATGAGCAGTAGCCGCCCCCACTGAGTGCT
AGCTCAGCACACCCGGGTGTCTGATTGCCAGTGATTCTTATAGTAACACTGCCAGGTC
TACAGTCACATTAAAGGAAACCAAAGTTCTCTGTCATGCCACACTACACACATCCTGTA
AGTGTTCTGATGTCTGTCCTGTGATATCAACAAAGAGGAAGCAATACTTCAGTGGAAGA
AAACGCTACTCAGTCATGGCACATAAAGAGAACCCTCTAATAATGTCTCAGATGAGATA
CACCTGAAATGGAGCATGTCCGAGTCCATCTGACTAGCGGGGAACACAAAGTACAGAT
GCATC (SEQ ID NO: 102)

eHGT_430h (297)
CACGGTGGGAGGAAGGAACATGTTACATTTCTTCAAAGATAACTGCAGATCGAATGCC
TTCATCCTTGTGACCCGCGCTGCCTGCACTGTGGTGTGTTTTGCTTGGTTTGCACCAAT
GCCCTGGCTGGCGGTCACTTGCTCTTGGTGGCCAGTTTCATTTCCTGGTTTTGAGAAA
ATGTCAGGGAGGCCTGTTGCTTGGGCATACTGTCACTGAGGGAAGTGTGCAGTTTTAA
AATGTCAAAGCCAGCAGGCTCATGTCCAGTGCATGCCATCAATCAGCAAATGTCCCTG
GACCCC (SEQ ID NO: 103)

FIG. 25 cont'd

Enhancer Name (Length) & Enhancer_Sequence eHGT_267h (786)
AGGAAGCATAAAGCTCCACTGTGCCGAAGTTGTGCAGGGTACACGTCTCTCTGTTCCC
AGCCCCGAGGCCTGGATAGTATGAGAGGATCCAGCCACCCTACCCCAGTGCAGCCCT
AGCCCCAGCAGAGCCACCACCCAGACCTGCAGCCCCGGGCTGGACTGGGGGTGGGG
CAGCCCTGAGCTGGGCCCATGCTGTTCACAGGAACCAGCTGTCTGCTGTTCGACTGG
AGTCCTGTCTCTCACAGAGTCCCCGGTCAAGCCTGGGTGCCCTCTACTGCCCGTGAG
CCACACAGCAGGTCCGGGGGCTTCCTGCCGCCCCTCCTGAGCATGCAACCCCACAGG
CGTGCCCGCCTGGGCAGCTGCTTCAGGGTCTGGGGGCAGCCCGAGGCGACGCCCAA
GCAATAGCGGCCCAGCGCCTTCCAGAAGTCTCCAGACACTGAGGCCTCTCCTTGCAG
GCCTGGTCGCAGCTTTATTGCCCCCACTCTATGGATGACTGCATGGGTGAGCCCACG
GCCATGCAGGGAGCCCGGTCCTCCGGGCTGGGACCGGCCTTGAGATGGGATGCATG
GCCAGGAGGCGGGCGATGGCCGAGGTGAGGGGCTCAGGGAGGGGGCTGGTCATGG
CATTCAGAGCCAGGTTATGATGGGGCCTGGCCATTGACGACAGACGGGGTGATGACA
GCGGGGCCCCAGGATGGAGCCTGCAGTCCACGACATTCAGAGCAGAGCATGGGGCA
TGCAGGAAAGGGGGCCAGAGGACCTGCTGGGTCTTTCCGGGTGTATGGTG (SEQ ID
NO: 104)

eHGT_268h (308)
AAATAAATTACCTAACCTCAACTTTTCTTTTTACAGTGAGGAATCTGAGGCCCAGAGAG
ATTAAGAAGCTTCACAAGTGACATGACTTGTGCCAAATCACAAGGTCATTTAGTTGCAG
AACTGGGACAGGAATTCATGCCCAGTTCTCTTTTCAAAACCCTGTGGAAAAAAGAAGCA
CATTGAATTTAGCCTTTGATTCGTCATCAGCATTATCAGAGGTAAAGCAAAAGGGAGTA
TTAACAGATGTTCAGCAAAATGGAGGAGGTAAATTCAGAGCAGATGTTTTGACAATGAA
GTAAAGAAGGAGA (SEQ ID NO: 105)

eHGT_269h (332)
TGCCAAATGGCACTGACAATCCTAAGATATTTAAATTTGCAGTTTAATCAATCTGCTCAT
TGTATAATTGTAGCCTGCAGTGTTCAGTATCTGAGGCAACAGATAGGACTACTTCAAGG
TTGGAAGACTGAAGAAGGGAAAAATAAAAGGTCAGTTTAGAATGGGACTGTTCTCCAG
TTAGTCTCCTTACAATATTCAGGGAAATGTAACATTTTCTTGGCCCAATTATATGCTTGT
TTGTTTGGAGACAGGGTCTTGCCTTGTTGCCCAGGCTGCCATACAAGTGGCACAGGAC
AGCTCACTGCAGCCTTGAACTCCTGGGCTCCAGTAAT (SEQ ID NO: 106)

eHGT_270h (505)
GGCTGAGTTTTCCAGATATCAAAGCCCAGCTGCAGCCTGTGACTTTCACACTCCTGGA
AAAGTAGACGTATCTGCCTGCTCTTACAGCAGGCTTTAGCTTGCCTTTGCTGGGACTTT
GTTCTGCCCTCAGTTACCACAGTAATTAGGTTGCCTCTTCTACTTTCCTCTTTTCTCACA
GGCACCAGGAGCCAGAGGAAATAACATAATAGTTGTTGACCAGAGCAGCAGCATAATT
CTTTCATGACTGCCTTTTCTAATTTGACGATTCCCTCTCCTGAGAGGGCTCTTTGTGTC
CTCCTCCTCTTCGTCTCCAACTTTTAAAAAAAAAAAAGTGAAACTATCAAGTATTGCTCC
TGCTAACTTCAGATCAGTATTTTCTTTCTCTGAAGCCAATGCAAAGTAATAACGGACGT
GCTTCATCATCTTAGCATTCAGCACACGTGTCACCATCTCTGATGGTGTGAGCATGTTA
AACCAGACTTGTGGGTACTTACCAAAAGGTTCA (SEQ ID NO: 107)

eHGT_271h (380)
AAGGAATCTTCTAGACCACAGGCCCCACCTTTGGGGAGGAGGGGGTCTGCAGAGCTG
GGTGTTGCCCTGGCTCAGTGCCTGGCAGAATAGAAGCCACAGAGGCAGCTGGGCCCT
GTCCTGCCCCAGGAGAAATCTCCCAGGGTGACCCACAGCCCTGCCCACCCCTCTGTG
AGGCAGGCAGGAAGTGAAAGAGGAAGGATCCCTGCGAAAGGACCCAAACTGTTTTCT
GCCATGGGGAGGTCGGGGGGGGGATGCCACGTCTGGCATCTGTGGGCGGAGGCTGA
GCAGGACTCCTCTGCAGGGGTGTGTGGGGCAGGCAGGATGGATGGCAGTGGGCACT
TCTCCCACTAGAAGTGGATCCCATAGATGACACTTCAAGA (SEQ ID NO: 108)

| FIG. 25 cont'd |
| --- |
| Enhancer Name (Length) & Enhancer_Sequence |
| eHGT_272h (514)<br>TGCAAATGTGTAGTTTTCTTAACAATATTGGCCAATATTATTTTAAAGAACATCTCTGAAT<br>GTTTTCACGTAAGAAAAGAGACTGTCCCAGAAATCCTGGACCCAGTTATCCTGAAGTTT<br>CCTCTGATTCATCAAGTATTTAAGTTTCCAGGCCAACAGAAGCCTGAGGCTCAAATATT<br>TGTAGCAAATCGGTGACTCAGGGCAACACAGCAGAACCCTGAGAAACAATGAAGAAG<br>GAATTGTTTATAATCTTGTGCTCAGTTACACAAAAGATACACATTTATTTTCACCACCAC<br>CCACCAAAGACCCCAGAGGATCCAGAGGCTATAATAATAGAATATGTTACCAAAGGAA<br>ATACAAGATGACCCATTAAATTTGAATTTCAGATACTCAAACAAAAAAATTTAAAGTATG<br>CTACAGGCACTATTTGGAGTATACTTATACTAAAAAAAATGTTGTTTATCTGAAATTCAA<br>ATTTAAATGGGCAATTTTTATTTTTGTTTTTGTTTTGTTA (SEQ ID NO: 109) |
| eHGT_273h (587)<br>TATCTAGAAACAGAGATTGAGAGCAGAGACAAATCCACAAGACGTAAGAAGAAAAAAG<br>TGATGGGCTTGATGATTGAGGAAGAAAAAGGACTGGAATGAAGTCTTGGGATTCCAAT<br>GGTCACTGGAAGGGGTCGGCAAGCTTCTTCCATTAATTCATTGCCTTTAATTATTTGAT<br>CATAGGAAAGGAGAGTCTGGCCTTGTGGAAAAACACACAATCAGTTTCATTAGAAAAG<br>AGAGAGTCAGATGTTTTTAAAACAGCAACAACAATATGCCCTGAATAGTAGAGAAACAA<br>AAGAGCGATTGATCTACAAAGGCAAGACCCAGATTGAGACCACAGTGAACCCTGCAAA<br>ACAGAGGAGCCCCTGGGTGGGAGGGGATATAACTGGAACTCTGGGAATGTAACGGGC<br>ATGGTGTGCTTGTCTGATGGACAGGGCAGCTTAGGGGAATAAGTCTCTGCAGCGTTGT<br>AGTGAAGAGAGAATACGGGACAACTGCAGGACCACAGCTCAGCCAAGAGTAAGCATA<br>AATTTAAACATATTTCTTGATTTCTCTAAAGTCTCTCTTTTCTGTTAAATACAAATAATAAT<br>GCA (SEQ ID NO: 110) |
| eHGT_274h (615)<br>ATCTTGTAGGGAATTTGCTTGAAAATAAATTTTACCCCCTTTCAGAGACTTAGTGTCCTA<br>AATGAGCTGATGGGGAACCTGGCCTTGTGATCCTTTTTTCCACTGAAGCAAAAAAGAA<br>GATTGTATAAAAAGAAATGGCTGCAGGATCCAGGATTTTGCCTTTCTTTGTTTCCTGG<br>AAGACTTCAATATATCCGCTAATTAGAGGTTGCAGTGAGCAGATATTGCACCACTGCAC<br>TCCAGCCTGGGCAACAGAATGAGACCCTGTCTCAGAAAAAAAAGACATCCACTAATT<br>AATGCAAAGTTAGTAATTAACTGGCTCCCTTTCCCTAGAACATGGTCCAGGTACTGTGT<br>TCACTTAAAGACTATCAGAGTTACCAAAACTGTTAGCTGGAATGATACAGGCATGGTTA<br>AAATCCTTTGGTTACATTTATACTGTTTCTAGGGAACCTGGCATAGTGCTGAACTACTTG<br>CACTATGGGTGATTTCACCCAGTCCTTTGATATTGTTGGCAGAAAGAAAAATTAATTTG<br>GGTTTGAAGTGTGAAGGTCCCAAGCATCTGGTTGTTCTTAATCAAATGTGTAAATTTCC<br>AGTTGGAAGTTAGTCATATTTCAGT (SEQ ID NO: 111) |
| eHGT_275h (483)<br>GGAATAAAAAGAACAGAGATGGGCGGTGGGATGGAGAAGAGGAAGCAACAGAGAAAG<br>TGTTTTTTTAGAGCCAGTTACAAGTAATAAGGCTAGTGTCAGCTTCACACTAACTTGTTT<br>ACTGGCCTCCACTGATAGTGAGAAGAGCCACAATAGAGCTGAACAAATAGGGAGAATA<br>AACAAGCTTGAAACATGCCCTACTTGGGAGGCAGCTTAATTACACAAACTGAAGTTCTG<br>AAGCAAATAGAGGATCCTCCAAGACTCCAGGGGCTCTGCTCTGCCAAGAGAAAGAAAG<br>CACCTTATCCCTGGGCAGAGAATTTCATTCCAGAGGAGGGGGAGGGGCTGCTGTTGG<br>TGGCTTTTGCAGTGGGTGGAGATAGAGTAGAGAAGGCTTGCAGGGGTGGGCTGGCAG<br>AGGGGAAGGGCCAACAATGAAGTTACAGATGGATGAGTGGGTTTCTGCCACAAAATCA<br>GATCAAGGAGAGGGAGGTG (SEQ ID NO: 112) |

FIG. 25 cont'd

Enhancer Name (Length) & Enhancer_Sequence eHGT_276h (519)
GAAAAGACCCACACGCCACAAGCAGATGATGATTCCATCACAGAAGGAGAGGAGGAG
GCCTGGAGGAAGGCTTGTCTCATCCTAGCAACCAGAGGTTTTCTCTCCTGGTGTGGCC
CAGGAAAGTGAGAAGACGTTTCCTTCCAGCTATAGTCATGGAGCCACAAAGTCGGGAT
TCAAGGCAAATTAGGCTGCTGATTTGTATGTTAAACAAGGTTAATTCCATCCATTAGCC
AAAGATGTTTTCAAAGCGCCTGGCACAAGAGCGAGGAGCAATTAGTGTCTTTGTATTA
GTGGATGTGGGCGTGGGGCCAGGACGTTAAGGGGAGGGGGATGCAATTTCTGCACT
CTTTATGATATCATCAAAAGTAAATGAATTATGAAAACAAAAGAGGCAATATGAGGCTTC
CAGTACTAATTACTGGGTAGGACAGAAAGTTCACAGTGAAGGAGGAAAGAATGATCAG
AGAAGGACAAGGATACGGATCATCTGGCCTGCAGGTGTCTTTAGACAAGGTGGGG
(SEQ ID NO: 113)

eHGT_315h (490)
AGGAGCGAACATGGTATGCATAATTGAAACACTCCTCCTTGTTTGAAATGTTGTCTCCT
CCTCTGCAGTCCTGCGGCAAAGACAGGCACACAGGCTTTCTCTGTGGATTAATTGGTC
AGGAAAGACACTTTTTATATTGTCAAGTGGCACTTAAGCCATTAATTCTTGACTGTGAAA
CTGCTTTTCCTGGGCAATGCTCTTTAAGGAAAAACTTATTCAGTCCAGTGACTGGTGAC
TAAGGGAACGATGGAGCACAGGGAATTGGGCGGGATCTAGACTCCTAATAATGCCTC
CTTAGCCAATGAAAAGCATTTCCTATTGAGACCCCCAAGAGTTCCCCTGGCCGTCGGC
TCCAGCTCGGACTTCAGGCCTTTTTGTGTCCTGTTTGCTAAAGGCATGCGGGCTACAG
CATTCAAGAGAGGGAGTCGTTAACAAAGGGAAAGAGATAAATGTAAATAAGCTCACATT
TACAGAATGAGCGGTTTGCAGT (SEQ ID NO: 114)

eHGT_316h (563)
CCATTCTTTTGAAGTTGGCACTTTGATTTCTAGATGGTTCCCCAACACAGGTTCTTCTCC
TCCTCATCATTATAGCTGCCTTGAAATTTGAGCTGGAAGGGAACATTCTGAGACCCAGA
TTGTTAAATGTCTTTTCCAAAGTCATGCAATAAATTAAATGGCAAAGCCAGGGCAGTTT
CTTGACTCAGTACAGGGTATTTTCTTTCATTCTTTACTCTTGAGACTTTAGAACTGTTGG
TACTGCTTTAAAATTCATGGCAAGAACTGGTCACTTTTGTAATTAACACCTCCTTATAAT
ACATTTGTTTTGTTTGCTTAGCCAGCTAGAAACTACATGGAGTCTGTGCTTTAAAAAGC
CTGCCGAAGTCCTTATTCTCTGTTTTGGTATTATGTGCATGAACCACCAATTGGTTCCTT
CTCACCTTACACTTGATGAAGATGTCTTTCTTTCAACATCTTTCTCTATTGCTCCCCATC
TTCTCTTGCTCTATTTATGATCAGCTGTCTGTTTCTAAATAGACTTTGTGGTCACCCATT
TCTTTTTGTGCCAGCTCCTATCCACT (SEQ ID NO: 115)

eHGT_357h (748)
AGGTTGTGGCCACTGTGACTCATATACATGTACATGAACGTATCTGAAGTTTTCAGGGC
TGATACTGATGTGAGGCAACCCATGCAGGCAACCCGGAGGAACTGTGTCCCTCACTCT
GAGACAGTGAGAACGGACTGAGCCGGAAAGCTGATGGCCGTGAGAGGAGCAGGTTT
GAAAATCACTGAATGAAGTCATGTTGTACAGAGGGGGCGGGGGTGCATACTGTGGGA
CGGAGGTGAGTCACAGTGCATAAGTGTTGGGGAGTCACCTTGAACTTGGGCCAGAAG
AGTAGAAATATTGAGACTTGGGTTTATCTGCCTCACATCAGGTACATCAAGTTCTGGAT
GGCTGCCCACTGGCCAGAGACATGAGGTGGACGGCTCCCTTTTGCTGCCCTGGGAAG
GCCTTCTGCTGGCTTCGGCCCCACTGAGCAAAGTCTGCTTGTTCACTGGAGTTCACAC
AGACTCCTTGCCAGGCCTGCCCAGAATCCTGTCTCCTCTGACTTCCTGTGCTCTTGCA
TAATATTTCCTTGCTCCCTGAATGGCTGGCCCCAGTGCAGGAGCAGCTCACTCACACT
GCTGGACCGAGGGCAGGATGTAGAGGGAGGGCAGGGATCTGCAAACGTCACCCAGG
GGTGCTCTGGGCTCTGAGGGTGGAGGGCAAGAGGGGGCAGAGCCCCCTCAAATTCTTT
GGAAGATTATAGCACAAGGGGAGTTGGGAAGGCCCTGGGACCATGTGCACACACATC
T (SEQ ID NO: 116)

| FIG. 25 cont'd |
|---|
| Enhancer Name (Length) & Enhancer_Sequence |
| eHGT_495m (469)<br>TGTAGACTGAGGCCCCGTGTCCAGAATAATTGTGCACTTCCACACACTCGCAGTCCAG<br>CACTGGAGTCTCAGCTGCTTGGCTCAGAGCTAGTGATACATCCCTGACCCCAGAGACC<br>CCCTGTGAGCCGGGGTTTCCTCGGGAGCTGCTGTATGAGCTTTCACCAGGCTGAGTG<br>TGTAGAGTAATGGGGTCTCCAGAGGAAGGGGGTGCCTCACAGGAGGGATGGGTAACT<br>CCGGAGTTTTGGATGCCCCCAGCTCCAGCATACCCAGCTCCTTCCAAGGCCACCCAG<br>CCCCCGCTGGCTTCAAACTTCACTGGCTTTTGGCAAATCCTGTTCCGCCAGGTCCTGA<br>GAACGGCTGCCGGTCGGAGCAAACTCAAAGGCCCTTTACAAAACCCAACAGCCCACC<br>CAGGCCTTGGGCCCCTCGTCTGTGATATGGAGGGCAGGTCCTCTTCGACTTCCCCAA<br>CCCCAGAGCT (SEQ ID NO: 117) |
| eHGT_497m (463)<br>TTAAAAGGCCAGGGTGGGACCAGACTGCCCAGATAAGAGGCAGAGACACTTGGAAGC<br>AAGGCTTGAATGAGTAGTCAGCTAGTATTTATGTAGTGCTAGGCATGTTGGGGGAAAA<br>CAGAAAAATTATAAGACGCCATGCAGTCCGTGGCGGAGCTTCTGGTGAGAGTCCCTTG<br>TGTAAGAATCAGGACTGGTGCCTGGTTCTGCCCAGCCGATGGAAGCCTGCCATGGTTT<br>TTGAGACTGGCTGGCTAGCCTCTGTGTAGAGCCACAGGGAGTAGTGGGCAAGCCAAG<br>GGTCTAGGAATGAATGAGTTGAGTCTGTGCCACGTACTACCAATGAGTCCCATTCCCT<br>CTAAAGCTGAGTTTCCATAGCTGTGCAATGTGAACCGCATCAAGACTTGCCAAGCCCG<br>AGCATACCTCAGCAGTTTATGGGAAGTGGAATAAGCCTAACAAATGTGGGTTCTGAGC<br>T (SEQ ID NO: 118) |
| mscRE1001 (1174)<br>TCTACAAGTGTCTCTTCGAACCAAAGGACATGCCTGCTAAAGCATATTTTATAATCTCTT<br>AAGAGCTGGAGTAAGCCTTAGTGTGGCAGGTCTGCGTGTCAAATAAAGGGTTTGAGAT<br>GACAGAACAGCAGCGTCCTCTCAGAAGGTCCAGCTGAGCCCCCAGGGTGAGGGGGT<br>GACATGCTGTGCACAGTGGCCCTCATTTGAGCAGGAATGCCGTTCAGGTGCCTGCTGT<br>GCCTCCCTGGTGCCAGGCCCAGCTGGCTCTCTACCATTCCAGCCCTCCTTTGCCACAT<br>CAGTTTGTTCTTAATTCCTTCTCGGAAACTCTGCTCCTTTGCCGCACACCACGTGTTCA<br>GCCAGGCCCCATCTGACAGCTGGGGCCCCTGGCGCAACCCCACAGACACCCAGTGT<br>CCCTTTCACAGGCTCCGGTGAGCCAAGTCTACTTCCTTTACAACCCTTTTATAGGCCCT<br>CCCATTCTGGAGCCTTGTGTGCCATGCCAATGGCTTACACACTTGATGAAAGGACTCA<br>GGGGCTGAGAACTTGGATCAATGAGGTCTTTATTTTTGAACATCAGTAAACAGCACAAA<br>TCAGTTGAATGGGTGCAGCCCTGTTCGTAATTCCAATGCTTGCTGTGGTTTCCAGCCA<br>GCATTAGACACACAGAGAAAGTGCTCGTTAATGCTAGCTAATGAAGAATGTGGCCCTTT<br>TTCCCTAACTTGAACACACTCCAAGACGCTGGCCTGAAAGATCAGTGTGACACTGGAG<br>AGGGTGAATGGGAAAATCTTTAACCTTCCTTTTGAAACAGCCCATTGACGTGGCTCTAA<br>CCACTTTCTTTCCTCTTCTTTTTGGTCTGCTCTCTGGCATTGCGGGATCAGCTTGACGC<br>AAAATACAATCTTTTTTAAGACCCAGAAAATCGTGCCAGGACCGTTTCACTAACTGAAC<br>TACAAATCGTGTAATTAGAGATGAAAGTCCCAGGAACCTTCAACTTGTGCCTGTGCCT<br>TTGTCAAAGTGGACCCCTGTCACTGTGTTTTGGGGGTTGTTCTTGTCACTCTTGCTGTT<br>TATTTGTGAAACCACTCACAGCTCATTCAGTGCCACCAGCAAGGGACATGGCCTCCTT<br>GTTTCAACTAAAAATAGTCATTGGTGTGGTTAAAACCACAGGAAAGTAATCTTTAAAAAG<br>ATTTA (SEQ ID NO: 119) |

| FIG. 25 cont'd |
| --- |
| Enhancer Name (Length) & Enhancer_Sequence |
| mscRE1002 (1143)<br>CACTTGCAGGTTTCTTCTTCCAGTCCCAGCCCTCTGGCCCACACCCCACTGCTGACCA<br>CAGGAGCCTCTCACAGTGCTCACTCAGGGCTTCAAAACTCTCTCCCTGGCAGCTTCTT<br>TCTATTCTGAAGTCTCCCAGTCCAGCACAAATTAGTCCCCTCTCCTGGACTCCTACTGC<br>GCCGCCTTGGTACATCACAGAGCACTGGCTGAGAAAATCGCCCTTTAGTCCCCGCAAA<br>TCACTCTCTTACCTGCTCCACTGACTAGGCCTGTGCCATTATTTATTAGGGAATGAGCG<br>CTAGCTGTTGAGGGTCAATTATTCCATTGACCAGGCATTACAATAATTCCTGGTAATTAA<br>AAGAGGTACTTATGTGAATCTGGATGCGTATTGAAAGAAACATTAGTCCTTTTGTCAGC<br>TTGGCAAGTCTATTGTTCTGAGCCAGGCCCAACCAATTAACATCTTTTGCCAATCCCTG<br>TCAGCAGGGGCTTGCAAGGAGGAGAGAAAGGGGGGCCGGTCAGATGCTAATTTAGAT<br>ACAATTGTGTCAGGGTGCATGGGAGGGGTAACTCTGAAGAAGAGACTCCAGTTTAATG<br>AAGCAAACAGCTTGGGTCCCAGTGACCCTGCAGGGGTAATTTTAAAAGGCCCCTCTGT<br>GTTCCTGTGCCAAATTGCAGAGGGCCAGCAACAAGAAGCCCTTCAAAAAAAAAAAAAG<br>AGGGAGCAGGATAATCATCCACTTAATCTGCTCATTAAACAAATCTCTCAGGCGGACTT<br>AACGTGAATTAGCACTTCTCTGAAAGGGGCAGCCTTGATGAGCAGCAGACAGCTCAGA<br>TCATTTGGAAGGTCACAGTTTTTTTTTTATTATTATATAAGCCCAGTTGTTATTAATGTAT<br>TCATATTTGAAGAAACTGAGCAGAGACCTGCTTTCATTCAATCTAGTGAGCAAAACAGT<br>ACGTTTTCCTAACTGGAAAACAAAACATAAATGCTAATCAGGTCCCAGCAGAGATCAAA<br>TCAAGCTAAATATAGCAGGCACCCTTTGTGGTTTTTTTTGTTTTGTTTTGTTTTGTTTTTT<br>GTTTTTTTTTAATACAGAAATTAAGGAAAGAAAAAAAACCATTGAATTAATTGTCTTCCTC<br>TGTGCTTCGCACCTGACACCAGCG (SEQ ID NO: 120) |
| mscRE1003 (1386)<br>GACTCCTTTCCCGTTTCCATCAAACCTCCCCCCTGCACACATGCAAGACCAGTTTTATT<br>TTTGTTGAGCTACACATTCGGTTCCCTCTTCTCTCCGGTCTCATTAACTCCACTCCGTC<br>AGATTCCCCCGCTTTTCTAATGATTAAAGTCGTGGGCTTTTTAAAAAGGCCTCCAATTA<br>GCACCTCATCAGCTCCAATTAGAGCAGACAAAGGCCGTGTAAAGATAACTCAGTGAGA<br>GGGGCGGGAGCAACATCATGTAATCACTTAAGACAGGCTTTGAGAATTCTCCCAGCGA<br>CCCACACTGGGCCTATTCACCTTTCTTTCTTCCTTTTGGATGCATTTAAGACTGTTTGGC<br>TGGGAAGACAGGCCCCCCAGGAGTCTCATAATTCCTCATTCACAGGCTACCTGTTTAC<br>TTCTGGGAGAGTCCAAGGACCTAAACAATCCCATATTGTACGCCTGCTTCCTTAAATTC<br>CAGATCCCTAATCGTGTGTTTTTGGTGGCCCTCAGAACAAGTTAAAGGCCAGCTTTATA<br>CTCCCAGAGGGTTCTCCTTGTACTGTCTTCTAATTACAGGAGAGAGTAACAATGTATTT<br>TTTTTTTCAATGAGAGTTCTTTGGAGCAGTTAATTTGGTGCCTGTACTAAATGCCCCCAA<br>ACATTAATTAGGGTGGAAGAAACCCTAATTCCCTCAGCAGCGTTGCCCTCCATTTAGTT<br>CCCTCGTTTTTCACATAGGCCTGGACGAGTCTCCATAATGAAATTACCTCATTAATGCC<br>TTTATTCTTCACAGTAACTCATTCAAAACCGACCATTTAGCTTTAATTGAATGCTGTCAA<br>AAGGAAAGAGGTGCATTCATGGCTTTGATTAGCAAAAAATTTTCCCCCCTGAGGGGCA<br>GACAGATTTAAATTATGAAGATGGTGAGTAGTGAGTTATAATTGGGTACAAGCAGCACT<br>TTAGGAGAGCTGAAACGTTTTCAAAGCCGGGGTTGGCCAGTCTGCGGACTATTAACTA<br>CGTCCAGGGCCTTGTTCTCTGTTTGAATTGATGGCAACTTAACTATCCAAAAGAAAATG<br>GGGTTTACTTTTTGTTTAATACACAGTGGGGTTCTATTTACCCACAGAGCGATCGTTTCT<br>TCATGAGCTCTATCTTTGTTCCCCTGATAATTTATTATTTGTGCTTTCTAACACGGGTGC<br>TGGAGGGCGCCAGCGCCGTGCATGGTGCAGTTTCCGGGGAGAGTTAGAATAGAGAGT<br>GCACATATTGAGCAACTGGGCTGCTGGCCCAGCGCCTCCCTGGGGCAGACACAGCGA<br>GGTGAAGCCCCGAGTCAGGAGCAAGTGGGTGCAGTGGAACCTTGGGAACTCAGCCCT<br>CAGAAAGTCTGCTCTGACTTGATGCAACAATGCTG (SEQ ID NO: 121) |

FIG. 25 cont'd

Enhancer Name (Length) & Enhancer_Sequence mscRE1004 (1661)
TATTTTATAGGCATAGACTTTGCCATGTAAGCCAAGCTAAGTATCCCTGGACCTTCAAG
TGATCTGCCTGCCTCTGCCTCCTCCACCATCATGAAGCTCACCATTGTCACAGCAGTTT
TTTACCTGGATGCTGGGGAATCTGAACTCAGGTTGTCACATTTGCAAGGCTGGTACTTT
ACCAACTGAACTACCTCTTTGGCCCTACTTTTTTTGTTTTCTTGAGAATGTTCTAGAAAG
CTCTCTGTTAGGTAATATTTTTTTTCATTTGAAGTTCAATCTTCCCTTTCTGTTTCTAAGA
CTCTCAGAGAAAATTAAACATTTATTCTTCTATTAAGCTTGGACAAGTACTAAGATTAAA
AAAAAAAAAAGCAAAATTAGCATTGCTTTTTCAAGGCAAAAGCAAAGACAGTTCCTTTAT
TTAATAACCTTCACTCATACAAGAACCAAGCTCATTAGTCAAGTATTGGCCACAGAAAA
TGAAACTCTTAAGTCTCCATGAAATAATGTCTTTGGTCCTATTTAGCCGAGTGAAGGATT
TAGACACAAAGCAAACAGAAACTTGAAATCTGGTCTTCTCTTCTCTCCAGAATATTTGG
TCTAAAGTAGGTCAGACCCTGCTGCAACTAATCTTAACACTTCTTTTGATTCTTTCACTG
GCTCTACTTAGAGGAGCTTAGAGAGGGGAAAATTCATCCAATTAGTTAAAGAAAAACTG
CAAATGAGAGAAAAGGCCTCCTGAATTGTGGTGCGGGGTCTCTGTCTCCAGCGCCAAT
GAGTTCATCAACTTGAAAATGATTTTCAAAAGAATAGCTGTCTATGAGGTAATCATTAAT
CCCCCGGATGCTTTAGTGGCTGCCCTGGCTGCCCTCAACCATCCATTCTCTCTCCTGG
AGTCTAAGAAGGATGCTGACACAGCTCTGGATGAAGCCAAGACCATGCCTCAAGAGAA
GAAGAGAAACCTAGAATGACCCTCAGTCCTTCAAGACAGCCATCGCTTCCCAAAAAAA
GGCCCAGCAAGGGGTTTCAAAACTCTAGAGTTCAGAAGAAAGTTGCCAGGAGGGGCC
TGGATTTTGAAGGTGTGTAGAGGAAGGGAGTCCACTGAAGGTGTTCATAGTCTACATT
GGTGTGTGCACATAGCGTCTAAATCCAAGCCGTTGCTTTTCCTTGGCCTCTCCCATGG
ATTCCCACCCGAACCACAGAGTGGGACCCTTGTTTCCAAGAGTACTTTCGCCAAAAAA
GTGCACAGCTTTTCACCACTTACGTGAAATGCTGCCAGCTAAATATCCTTCTGAATGAT
GTCTTTGAGACTTCCCAGGCACTTAAGCTCCTTTCTAAACCATCACAGGCCAACAAAGT
CTGTGAGGTTTTAAGGGATTTTTGCTGGTCCCGTGGCTTATTCTTTGACCACATCAAAA
TCCAAGGGATTGCTCCAGAAACTGTGGATACAGTTTCTTTTCTTGTTGCTATGACCAAA
GCAACTAAAGAAGGATTTGTGTAGCTCACTGTTTGAGGGTGTGATCCATCGCAAAGAG
GGAAGGCGTGGGGACAGGTTCATGAGACAGCTATTCACACTGTATGAGAGGCCCTGA
AGCAGGGGAGAAATGCTGGTATGCTGGTGCTCACTTTTCTTTCTTTCTTTCTTTCTTTCT
TTCTTTTTTTTT (SEQ ID NO: 122)

mscRE1005 (994)
TGCCTGTGAGTATGTCTGTGGGGTACTCTCTTAATTAAGTTAATTGATGTGAGAAGACC
CAGGCCAGTATAGGGAGCACCATTCCCTAGGCAGGGGGCGGGGTTATGAAACAAATGA
GTAGGGGAAATTGAGCTGAGCACAAGTAGCCTGCATACATGCAGTTAGTTCTCTCTGT
TCTTGTCTGTGGATGTGATGCGACCAGCTGCCTCAAGCTCTCACCCTTGTAGGTTCCC
TACACTGATAGACTGTAACCTGGAATTGTGAGCTAAATGCAGCCATTTTCCTTTCAAATT
GTTTTTTAGCCAGAGTAATTTTACGACAGCCATAGAAACCAAACTAGGGCAGGCCCCTA
AACACAGCATTTTTAACAAGAGCCCAGGCACTGCTCTTTCTGCTGAGCCTTGGTTTTGG
AAAGAAAGGTCAAGAGCCTTTTATGAATGCAGGATGCACCTCTCTTATGCTTCCTCCCC
TTGCCCCGTCTCCAAGGCATCCATTGAGTGCCTGTGTGCATGAGGCTGGGCTCCAACT
TGTAGCAAAGAAACAAGACACTTGGCATTCAAAGGGGACTCGGTGTGGACCCAACCTT
GGAGCTCTCCCTTCTTCTTTTATTTTTTGGCTAAGAGCAAAATGAACCACAGCATCCAG
TTCCTGGGGCGCACAACCATGGCCTTACTTTTCAGGGAAACAAACCCCCAAACACTTG
GAGAGAAGCTGGCTTTAGGGCTGTGCCTGTGGCTGTAAATCGCCTTTGAACATTGTGG
AACATCTTGGGCCTTTCCTTCAGAAGTCTTTCGAAATTGTTGACGTCCCTGCTGTCTGT
AAAGAGACAAACTGCTCTTTCATCTGAGCTCACTTGGCATTGGGACATGGCCTGTCTGT
CCCCTTGGCTTGTTGTTTCTAACCTCTTCCTTTCTATCCTGTCTTAGTCTGGAGCCCTGT
CGCTCTGCATTCAATGGTGGGCATTGTCACACGAGTGAATCTCACTTAGCCCAAGA
(SEQ ID NO: 123)

FIG. 25 cont'd

Enhancer Name (Length) & Enhancer_Sequence mscRE1006 (1117)
GACTCATTCATTTCTCTCTTATCTTCAATGTTAGGGACTGATTCAAAACAGCATAATCAA
AACAAAGCAGAGCACAGCATAATTAAAATCATGTCTTCTGAATAGGTAATTACAAAACTA
ATTGGATATTGGTAATTATTTTCTTTTTACCTGTTCCTGGCTCCTTTCTCAGTTAATATGT
AGTGCTATGTACAGATGAAGTTCAGATGCAATTATGTACAGGGTCTATCTCACCACCAG
GAAGCAGGACTTTTCTGTGTGATCTTCCATTTCCTGCAAGGACTACAGAATTGAGGTAC
AAGTGCCTTTTGTTTTCCTCAAGTTGAGTCCTTCTGTTTTCTTTGTCACTGGCTTTCATC
CTCTGTCCCACTGGCTGTGGCTCAGTGTTTATTTATTGGCTGTTTAGTATGGAGAAACA
TCCAGTCTTTCAACATTGACAACAAATCCAAATAATGAGCCTGCCCATCACGCTACACT
GGGTATCATCTTTGCCTGTTAGGCTCTTGGCTGGTTTTTGCTGTATTTGACTATCCTCA
AAGTTTGGGAGTTCTGACTGCGGGTTGTTATTTTCCAATTCTTATTAACACTTGCCAAAT
CTTTTGTCATGCATCTTTATACTCATGACAGCTTCTAGGTCAAATTTTAGTTTTGATCACT
GGATCTTTAGAAGGAAAGCTAAGGAACTGACAGACATAGCCAGCTCCTTTTTTTATGCT
GGCAATGGATACTGATTAGCTGTGTGCTAGTTGTTGAAGTCATAGCAACAAGTCCTACT
TACTATCTTTTAGGCATCTCAATTAAGTTTCTTTGGTCTTTGGAAATATAACTACAATTAA
GTTTCATCTCCTGGAGAAAATGAGTATGTTCAGGAGAACAACTTCATAGAGTTAATTAA
GAACTCTTTTCTAGAGTTCATTTTTAAACTGGTAAGTTATTTGTACTCCTTCATTTTCCTT
TTGTTTCCAGGTTTTATAATAGGCTTTTGATGGATTTAATCTTTTAATTTCAAACTGACTA
TTTGCCAAGATTCTGGATGCCTTTGCTGAGGCTACCAAGTTAAGTATATGCATCAGCAA
CCAGAGGAAAAACACTAACGTTGGGCAGAGAAGCAATGAA (SEQ ID NO: 124)

mscRE1007 (1490)
GAGCAAAGTATTTCCTGACACCGAGCCAAAATAATGAAGAAAATAAAGTTGGCCCATAA
TAACATCGGGGGCTACAGGAAAGACACTCAACAAAAACAAGTCACCCCCTGGTACTCCT
CAAACTTTGTTTTAATTTCCCACAGTGGCACAGAAAGTCTCCTGGCCACAAGTTACCTA
TCATCTTAATTTCTGCTTCTTAGAGGGTTTGTGTTTGGTTTTTGTCCTTAATGAGACATA
TTTGCCAAAGAGGCTTTCAAAAGGCATTTTTTGCTCTTGCGGAAGAGTAATTAGGTCGG
TACCTCTTTCCCTGCCAGCATCAGCTGCCTAAAGAGAATCCTGCCTAGTATTTAATGCC
CAAACAGAAGAAGCATCATTTCCACTAATTGGTCCTGAAGTTCCGATGTTCCCAAAGGG
TCTTTTTATTTTGCAAGGATCAGAAAGGACACACGTAAAATGTGATAGCGTCACCAGTG
ACCTTCATCGCTCTCATCTGCACTATTACCGTCATCCTTTCTTATATTTTTTTCCCCCCA
GTGGACGGGAACACAATGCCAACTGAGGGAGTGAGGAAGGCTTTTGCAAGTTTACTG
CTGATGGCATCTCTGGGCCAAGTTCAAAGGTCACAGCAGAAATGCTTATAAATGAGAG
AAAAAGCACAAATGCATAAAATATACAAGAGTTTGATTTCTTTGATGGGTCCATTTTAGG
GACAGTGTTAAGTACTCGGGGGAAAACGTTACTGTTGGAAGATGAGGATGCAGACGCA
AGGGAAATACGGGACGATTCATCAAGTGAACTGGAAATATAGTATATACTGCTAACTGT
TTTTGTTTTTGTTTCTGTTTTTGTTTTTGTTTTTCCTTTCCACAGCCTAAGAGGAGTTTTG
GAGTATCATATCACGCACTCTTATGACGAGAAGGGAAACAGATGATAGGAATGGGGGA
TGGGCATGTAGCAGAATATTTACACAAACTTCTCGTCATTGAAAGCTCTGGAAATGGCC
TTATTAACTCTCAGGAAGTTTCCAATTCTTTAACGTAATGATCAGGCTACACGGATGCC
CTTAGAAACATGGCCAAGCAATCATTAGGCAGAGCTTCAGCCATCCCCATTCAGATGG
GCCAAAGAAACCAGACTGGAAGAACAGACTGCCTGCTCTGTCTTCTGGGTTAAGTTCC
CTTTTTTTTGCTTATTCTTCTTTTTTTGACTTGTACCTTGAAAATGAAGCTCAAAGCCCTA
TCATTTCACTATGTTTTATCCAAGTGACAGGCAGGCTCTGGCTGTGGCCTTCTTCTCTC
TTTAAAGAGCCACTTTTCACTGCAGAAGCCCAGTGTCAAAAGGCTTGAGGTGAATAAA
GAGGAGGAGAGTGTTAAAGAGACCCTTTCAAAACCAAAATTGTATGTTCCCATGAGCAT
GGTTTTCTGTGCCACTGAAAGATTGGCTATGCAGAAACGAGCCTGCTTGCCAGTGTCT
ATACTGTCTGCTTACTTT (SEQ ID NO: 125)

| FIG. 25 cont'd |
|---|
| Enhancer Name (Length) & Enhancer_Sequence |
| mscRE1008 (785)<br>ATGCAGGCACCCTGGCTGATTCAGACACTGGACAGGAAGCACTACTGCCTGCCGTTTC<br>TTGGGAAGCGACTTCCAGTCTCCAAACATTTTCCTCTGCTGTGCAATGGGCATCCACA<br>CACTTAGCCTCCTGTCCTGCCCCGTAGGGTTGAGCATCCTCAGACTTGGACCCTGTGG<br>GATCTGCAGCCAGGTGCAGAGGCTGTGCACACCTGTAACTTCAGTACTTGGGGTGTG<br>GAGACAAGAGGAGCAGGAGCTGAAGGTCATCCTTGGCTAAACAGAGTTCAAAGTCATC<br>CTAAGCTATGTGAGACACTCATACAGGAATACATTCTTAAAAGGAACTTTTGTTAGCCC<br>CACCTGCAGGAAGTAAGTTTGTGCCAAAGCCCTGGGCCCCTTACCTATGCAAGTTCCT<br>GTTAGGTTACACCATCCCCCACTGAGATCTAAGCCTTGGAAACCCCAGGAAACAACTG<br>AATGTCCAGTCCTTTGTGCCCTTCCTGATGAGAGAGCCTCTCTCCCCACCTACTGACA<br>CTTAGCAAAGGCTCCATCACGGCCCCACCTCTGGTTAAAGGAGGAAGCTGGGTCTGG<br>GTCGGAAAGTCCCGCCCAGGTGTGAAGCAAGCCCTTCCTCTGCCCACACCCTTCACC<br>ATGCCCAGAAGATAAAGTACACAGGATGAGGGCCAGCTCATACACAGCCCTGCAGTC<br>CTGTGCGGCACGTCCAGCATGTTGTTTGCCTGTGCTCTCCTTGCCCTCCTGGGTCTGG<br>CAACCTCCTGCAGTTTCATCGTGCCCCGCAGTGA (SEQ ID NO: 126) |
| mscRE1009 (566)<br>GTGCTGCAGCTTCTGTTCACAGATAGAAACCATCATTTTGTTGTCCACGGTCTCTGAAG<br>AGCAACTGACAGAGGAGGCTGGTGGTACTTGAGGAGAGCAGCCTGTGGCTCCGCCTT<br>TTCCTTCCTGGAGCACTGCTAGCTCTTTCCTGAAGCCTCTGCCTGGCCCACAGAGCAG<br>ACGTCACAAGCCAGCTTCGCTAGTGAGTTATTACAGACAGGAAAACATCTAGAGACTG<br>ATCAGACCCAAGGAACAGGCTGAGTCATACAGCAAGGATGCGACTTTTCTGAGAATGC<br>CAAGACTCACAGGATGTCTGGTGTTTTATAGATAACAATTGTTAGAGAACACAATTATG<br>GCAGGATGAAGTCAGTGGGGAGAGCTACAGTGTCTCACAGCAGTACTTCAGATTCTGC<br>ATCTGTAGATAGAGCATCAAGCAGTGTGTACCTGTCGGTGTCTGTCTTGCTTAAAATAC<br>AGCCTAAGACTGACAGAAGCACCTTGAGAGGATGAAACAACCACTCATAAACAGAGAA<br>GTCTGAAACACTTATCACTTCCCCTGAACATCAGTGTCTCAG (SEQ ID NO: 127) |
| mscRE1010 (431)<br>AAGTGCTGCAGCTTCTGTTCACAGATAGAAACCAGAACTTTGTTGTCCAGGGCCTCTG<br>AAGAGCAACTGACAGAGGAGGCTAGTGGTGCATGAGGAGAGCAGCCTGTGGCTCCAC<br>CTTTTCCTTCCTGGAGCACTGCTAGTTCTTTCCTGAAGCCTCGGCCTGGCCCACAGAG<br>CAGACGTCACAAGCCAGCTTCACAACTACAGACAGGAAAACATCTAGAGACTGACCAG<br>ACGCAAGGACTAGGCTGAGTCATACAGGAAGCATGAGACTTCTCTGACAATGCCAAGA<br>CTCACAGGATGTCTGGTTCTCTAGAGTTAACAATTGTTAGAGAACACAATTATGGCAAG<br>ATGAAGTCAGTGGGGAGAGCTACAGTGTCTCACAGTCCTACATCAGATTCTGCATCTG<br>TAGAGAGAGCATCAAGCAGTGCGTA (SEQ ID NO: 128) |
| mscRE1011 (380)<br>AGTCTTAGTTTGTCTCAGGAGACAGAAAGAGATGAAGCACAGAAGTCCAGTGGTTAGG<br>GCTGATGCTGTTCCTGAAACCCAACAGGGAGGGGGAGGAAGGGAGAAGGGTCAGCT<br>GTGTTAGGGGCCTCCAGACAAGCTGGCCAGAACAATGAAGAACAAAGCCTGCACGCT<br>TTTCCGCTGAAGCTCAGAGCCTGGCCTTGGCCTTCTGTGAACAGCTCTAGGAAATGGC<br>TGAGATTCCAGATTTGGAAGGAAGAGACTGGTAAACAGGAGCTGGGCTCTGAGGAGA<br>AGGCAGTCTCTCTGGGTTTCAGGGAGGAGCCAATACAGTCAGCTTAGTTGTTGTGTAG<br>GTTGTGTGCTATGTAGCCATAGAAGACAGGTGTCAG (SEQ ID NO: 129) |

| FIG. 25 cont'd |
| --- |
| Enhancer Name (Length) & Enhancer_Sequence |
| mscRE1012 (512)<br>AGCAGCAAAGAGGATCCCCACCAGACCATACTCTGGAAGCTGCCCTGGGCCAGCCAA<br>GGCCAGCTGGGCCCGGGGTCAGTTGCTGTGGGTCTGAGTGTTCAGCCTGTCCAGCTC<br>AGTGCACCTCGGTGCTGGGGAGGAAGAGGAAATGATGGTTAGGGTAGGAGGGGTGG<br>CAGGGAGAGAGGGTGGGAAGAGTTGTCGCCTGTAGTCCTCCCGTGTCCAGCCCCCAC<br>AAGCCCGGGATGGGTGTGGCCTGGAAGTCTCTGGAAGGGGGGGCATTAGAGGTGGG<br>AGGCAGGTTGTGACAAGGACAGATCTGGGGATGGTTGGGCTCTCTCTCCCATCCCTTC<br>GGTCCCTTCCATCTGCATTGCTGGAGCACGGGAGACAGGAAAGGGAGGAAGCCAGTG<br>GCTTCCGCCTATTGAGAAGGTTTGGAGGCAGGACATTGTTCTGGGGTCTCCCCTCCTC<br>CCAGCACACACGCTGGGAGGAGGGGAGACACACACACACACACACACAAATAC<br>AAAATGAG (SEQ ID NO: 130) |
| mscRE1013 (551)<br>CATCTGGTTGGCCTGGACCTAGAGCATGCTGGCCCTGCCACATGGGGTGATTGACTA<br>GGTGTGAGCAGGCCCAATGGAGAAGGGCACTGCATTCCCTCCCCTTGTCAGGCTTGT<br>TCAAGGAACATGGAGAGATACGCCATTTCCAAGCCCACCAGCAACATTCCAGTCTCTC<br>TACACCTTTTCTGATAAGTTATGGGCAGCCTTTTCAGTGATGGCCACCCAGGTAGGTGT<br>AATGGGGACATGGATGGTTTGATTATGATGGCGGGCATCTTTTTATGTTCATATTTATC<br>ATTTTTATAACTCTCCAGAGAAATGCCTAGACGCTAGCTGGAAACTTTTCAGGAAATGG<br>AAGTGCGTATGACTGGGAGGAGTTCCTTTTGGGTCACAAACATCCAGAGGAAACAGAG<br>GAGAGCAACACCTGGCAGGGAGGAGGTGGGAGGGGCATCACTGGGAAGGGGAAAGA<br>GGAGGAGACTGCTGAGATCACTGAAGAGGGGAAGCCAGGCAGTGGTGGTGCACGCC<br>TTTAATCCCAGCACTTGGGAGGCAGAGGCAGA (SEQ ID NO: 131) |
| mscRE1014 (379)<br>TCAGTGTGAGGATTTCATTTAAGAAACCCTAACTCAGACATGAAGTAAACCCTTAGCCT<br>GCAGTTAGCATCCCGGGGATTACAGCTGAAGTGTAGAGGTCAGAGAGTTTCTCACCTC<br>TGGTCCCCTCCCAGTTCTCTAAGGCATGAGGGCCAGGCAGGAAGCATCCGTTTCCTCA<br>AAGCTGCTTCCCTACTGGGACAGAGTCTCAGTCACAAACAACTACCACCACCCCACCC<br>CTCCCTTTCTTCCCTTACTGCTGTGAGCTCAGAACAACCGGACAAAAGTGTATGGGAC<br>AAGGAGAGGAGCCGAGAGCAGCCATGGGCTCTGGAGGAACGGGCCTCCTGGGGACG<br>GAGTGGCCTCTGCCTCTGCTGCTGCTTTTCAT (SEQ ID NO: 132) |
| mscRE1015 (529)<br>ATGCCATGTGCTGAAACCCCTGGGAGCTGGCTTACCTGGGCTGTAGAACAGGATAAG<br>AAGAGACAGGCTCCAGCAAGCAAAAGAAGACATCTCAGGTGGGGTCTGTGGGGTCTG<br>TGGAGTCTATGGGCTTCAGGGGCACAGCTGACGGCTGCCTGGAGGGTTAGGGAGAG<br>ATGTCTGCTACAGGTCGGGGAGTGAAGCCTGGCGCTCCCAACTGAAATCCACAATCTC<br>CTCTGTGCCAGTGAGCTCATTTCCTCTAATTATCTGAGATCAGGAAACAATATGCACAG<br>ACCAGCTCCCAAGCCTTTAGGGCCTCAAGAATTCATGCAGAGGAAGCCAGGAAGCAG<br>CAGATAAGCAGGGGTGTAACAGGGTTCTCTCACGTTGCATGCTCCCTGTGCGGGGATA<br>GGAAAGCAATGGGAAATCACATGCAGGAAGTGTGTGTGCATGCATGAATGTGTGCAAG<br>CTTGCATGCACTTACGTGTTTTGTGTGTGGGTGGGGGGAGTGTACATGGAATTTCTTTA<br>ACTGTACATT (SEQ ID NO: 133) |

| FIG. 25 cont'd |
| --- |
| Enhancer Name (Length) & Enhancer_Sequence |
| mscRE1016 (566)<br>GACGCTGAGCAGCGGCTGCCTCACCTGCCGGGCGCTCCGCAGCTACCCAATCAGCTG<br>GGGTCGCCCGGCAGCGGCTGCCATGTTCTCCGCTTCGCGCTGCCAATCATTGTGTCG<br>GTGGCCAATGGGCGACAGGGCCGGGGGTCAGGTGATCTCAGGCCAGCTGGCTCCCC<br>ATTGGTGCGCGCTGCCCAGCCTCCCGCTCGGTTTATGTGCGAGGAGTGAGTGATTGA<br>CTTTATCAGTCCAAGGACATTACTCTGGAGGTGAAGAGGCTTGGACTCGCGAAGCGAG<br>CAGTGAGGTTCGAGCCTGCTTACTGCAGGCTGCCTGCCCTCTGGCCACGTTCCGCCT<br>CTGCTTCTTGGTGCAGTTGCTCCTGAAAGCCGGGACCCGAGGAGCCTCTGGCCCCGT<br>GGTTCCGCGCTCTTGAGTAGAGGAGGGGTGTCCGGGACAGGATTGACAAACCCCGCC<br>CTCCACTTATTATTTTGCTTATTTTTCTTTGTGCGCTCCTGTTAGTTTGTTAAGCAGATTT<br>AGTCCTAGAGTCTTTTCTCCTCCCTTCTCCTCCCTCCTCCTCTCCCATC (SEQ ID NO:<br>134) |
| mscRE1017 (1747)<br>TACCCTATTTCTGGGATTTAAGCTTCAGAACTGGGCACAATCTCAACCATTATCCTCTG<br>CTGCAGAATGAAAACCTCCCCAGCCTTGATAAGCAGGAAGGGAGGTCACCTCACCCG<br>CTCTGGGAACCTGCAGCCTCCACCTGCTGAGGGGCTGGCTCTCTGGAGAAGGGAACA<br>CATACCACAGGGGACACCCCTTCACTCTCCTGTGCATAAACACCCTCTCCGCTGGAGA<br>GCTGCCTAACTTTTCTATGGGGTTAGCACTTCTGTCTAGTAGGTCGCACTTGGGCTGCT<br>CTGTCTGTCTGTGGATCTTGTCTCTGGTTTCCATGGTTCGTGTAACAAGTGGGACTCTT<br>GAAGTCAAACAGGTGGGAGGTGTTCCTTGACCACGCATGTGTGGGATGCCATCTGCCT<br>GCAGTCCCACTAGCACCCGAGGCTGACCCCAGGCTCACCAGCGTGTGGCTGGTCACT<br>AGCCCGATGGGAACACGGCACAGAGGCAAGTGTGGCGAGTCACTACCTAGGCAGAAC<br>GGGAAGGAGCACATGAAACAGGCTGGCATTGAACTTGACAGAGATGGCAGAGATTAA<br>GAAGGCAGGGAGAACAATGGGGGGAAAGCCAGAACCAGGGGTTTGAGGAGAAACTG<br>TAGGGGCTGCTGAGGCAGAGCTTTCCTGAAGGGAAAAGAACAGTAAGAAAAACAAAC<br>TCCATTTCACAGAGGCAACAATAGAACAATCTTGCTTCTTCTGCCCTCAAGTTTATTGG<br>CCTCCAGAGGCTCTGTGCTTCCAAAGATTAGCCTTCCCCTGGGAAATTAGGAAGCAAA<br>TATTAGTTCTCCTCTCATGAGGTCATTCCTTGTAGAACGCTTCCTCGGGAGCTCTGCGC<br>TGCTTGGCTTTCGAAGCCCCATGCCCACCCGGAGTTTCAACCTGGAGTCAGGGAAAG<br>GCTTAGAAATTATCTTTGAATCCCAGGAAGACAAAACAGGAATGGCCTCAAGCAGGGC<br>TTCCTTCTGAAACCTGGGGAAATGGCTACTTCTGCCTGGCCTGAATTCAGGGGAACAG<br>TGCACCCCACCTGCTCCGACTGGCAGTTAAGGAGGGCCACATTGAAGGCAGCAGACT<br>CCCAGCTGTGCTGGCGGGACAAAGCCTTGATTTTTTTTTTTAAATCTCTGATTAGTCAT<br>TGTGTATAAGAAATGTTTTGAGTTAAAATAATATACAAGAATTTCCTTAGAAAAGAAAAT<br>ACACACGCTCATTTTTTGGATCCACTTAACACACTTAGCAAAAGGACATTTGGAACAAC<br>ATGACACGTCTTAGCTTCGGAGAAGGGTGGGGTGGACTCATGCCATCACAATGGAGAT<br>GGATGTGTGGTTTATTGGCCTCTCAGCCACACACAGGTGAGTGACAGGCCACTGTTAT<br>TCAACTGTTTAATGCCAGCTTCTCATAAATCAAGGTGACGCCTGAAAAGATTGAGTCTT<br>TAAATCAAACTGCCTTTTCCTATTTCGAATATAATTTGGGCTGTTGCCAAGGACTCTGG<br>GAAACAGAGGACTACAAGTGCCATTTCAACAAGAAACACACCCATTTAGGACCGGATG<br>CAGAGCTCAGGGCTCCGGACCACTTGCCAACAGAGTTTCACAGTCACATGACAGTGAC<br>ATACTGCTAATGGGGTTAGCAAGTGACTCATGGTCTCATATCTGGAGAATGAAGACTG<br>GGGTGGGTGTTAGCTTCCAGGACCGCCATAACCAACATGCCAGTATGACAGACTGCC<br>CCGTG (SEQ ID NO: 135) |

| FIG. 25 cont'd |
|---|
| Enhancer Name (Length) & Enhancer_Sequence |
| mscRE1018 (688)<br>CGGAAGAGCATAGAGCGTGCCTGTGGCTCACAGTCTTTGAACATGGATCTCTGAGCAC<br>CTGCAGGAGCCAGGCTCTGCAGGGCACAGCGGCTTAGACATCTAGACCTAGGCTTCC<br>AAGTGACCCCCAGGAAAATCCTCTGCTTTTCCTACCCCCATGGCGTTCACAGGCTTGC<br>CTCCATCGTAAGGTCAGGACGTCGGCAAGCACAGCCACAGGACTAGGCCAGCCAACT<br>GTCTCTGTCCCAGGCGGCAGGCTCTGACGTGTTCCTCTGGGTTTGGAGTCAAGGCCT<br>GCCGTGTTTGTTCCCTCTCACCAGGAAGTGAGGGCTTTCCTTCCTGAAGCTTGGGAGG<br>CCACGTTCCTTTTCACTCCCCAAAGAGGAAGCCTTCTCTGTCCTCAGGCCAGATATGT<br>GGAGGGCTGACTTCATGGCCTGAGACGAGTGCACAGGAAGCCGTCTTACCTAAGAAG<br>CCCTGGAGGAAGCCTCCACAGGCCCCACAGGAAGCACAGCCACGTCACCTTCTCCAG<br>CAGGGAGGCCAGTCTCTGCCCAGCTCCATCCCACCTGACCTGCCATCTGCCCAGCCT<br>CCAACCCCTGAGACGTCTCCTTTCTGGCCTCCTCAGGCTCCTGAGCACATTTGTGAGT<br>TTACAAAGATCAGAGGTCGCCGGAGATCAGAACCAGTGCACCCCACTGCCCCGCAG<br>(SEQ ID NO: 136) |
| mscRE1019 (1032)<br>TGGCTCTATTGGTGCTAGAGTTGAGGAGAATTCAAAAGGAGACAAAGGGATTCTTCCT<br>TTGATCCCTGCTAGCGTGGAGAGGAGAGTTTCAGCCCCTGAGGAACCCTGCAGACAT<br>CTCTGGGAGGTGAGGAGGCCCATCCTGGAGCAAACTCTGCTATTTCCAGAAGAACGA<br>GAATAAGTCATAAGAGGCCACTGGCTGGTTTGTATTAATTGTCACTATTAACAGTGTAA<br>AACTTCAAAGGAGAGAATGACTGGCAACAAAATTAGTTTATTATACTGGGTACAATAGA<br>AATTAGACTAGTCCCCTCCTCTTGTCCCCTTTAAGGGATTTCCTAAGGCCACTGGGAAC<br>ACCATCCCTGGACTTTCAGGGTGGGCTGCAAGGCTCAAGCTGGTTGCCAGGAAGTTG<br>TGCCGGGCCAACCCCATGTTCCTTCTCTGGCCTTTGTCTGCTGGTTTCAAAGGCATTC<br>CTTGGGAAAGGGCATTGGTTGGTGTAAACAGCTTTGAATCTGAAGAGTCTCACCCCTC<br>TCTGGAGCACTTGGAAGGTCCAGGGTTTTCCTTCTAGGAAGTGGGAACAATGGGAAGA<br>CTTTATTTTAGCAGCAAGCAGGACTTGTGATAAGAGTGCACCTCAGAGCTGGTCTCTGT<br>GTGTCTAGTTAATGACCAAACATGGGGAGGAGCAAGAATACCAGCGTTGCCTTAGGAT<br>GAAATGACTGACATTCCTGAAGCAGCCCCAGATTCCTCACATCCCAACTGGCAAGACT<br>CAAGTTCACCCACTTGTGAAGAGGACACATGACAGCCCTCAGTCCTTCCCTTGGCTTT<br>CAGCTTATTGTGTCGAATGACCTCTCTTCAACTAGAGAGTAATGATGGATGATTGGACC<br>ATTGTTTGCTAGGCTTAACTGTGTCAGGGGTCAAGATCCAGAGCTACAGAGAATTCAG<br>CTTTCATGGGGAAAAAACCTAGAAGAAGACTTCCTTCATGTGGCTAAATATTTGGACA<br>TCAGAAGGCAGTGGCTCTGCAGAAGCAATCTGAAAGGGCAGAC (SEQ ID NO: 137) |

| FIG. 25 cont'd |
| --- |
| Enhancer Name (Length) & Enhancer_Sequence |
| mscRE1020 (1618) |
| TCGGGAACATGGGGGGTCAAGTGAGAGAGCCAGGTGTCTCCAGCACTCAGCATGATAT |
| CTGACACAAATCAGACCCCTCACTTTTAACACTGTACCCTAAGACTTGGGGCACAGGC |
| CAGGGACTTTCCGTTCTAGGCTCTCTGGCTCCTGCTTCTTGGATTCTGATCTCCGGTCT |
| TATCGACTTCATTTCCAAATTAGAGGTTTTTTGGAACCCAGGGGCTACCAGGCCAACCT |
| GGAAGTCCGACTGCACATGCTGTATCCGTGACAGAGTTACAGAGAACAGGGACTGCC |
| CTGAGTGGGACAGGCCGAAGAGGGACTGCCAGAGAGGTACAGACCCCACCCCCACC |
| TTTGTAAGCCTGATTGCCTACCCAGGCCACCACAACTCCATCCAGCTCTGTCCCCGCC |
| TTTGTTCCTGAGTCTCCAAGGCCCCCTTTCCTGCCAAACAAAGCCCCCAGCCACCCGA |
| CTGCCGCCCAACAGGCACCTGGGGCCTCTGGGCCTGGGAATCAAAGCCTGTTTTGCA |
| AAGGAGGCCCAGTGTTTGGAGAACACCCATCCCCTGCTGCCCGGTCCTTCAAAGAAC |
| CGGCATTGTTCTGCGCTGAGAAGGCGCCTCTTGACGCGCTGGGCAGGGTCGGCTTGA |
| CGCTGGTGGACCTCTGATCTCAGGCCAGGCCCCCAGCCACTTGGGGGGGAGGGTGGA |
| CTTAGGGGCCAAAGAGGGAGCAACCTGTCCTTGGGGCACTGTGGTCCTTCCTCATTCT |
| CTGCCCACCCGAGTTCCCATCACCGAGTTCATTGAGACCCAGGCTCTTCTACCTGGTG |
| ATCTGGACAAGGCAGGCCTCAGGAGGCACCAGGACAAGAGATGAGATAGCGGGCAG |
| GATTTTAGTGACCATAACAGGTACGTCAGAGACTGCAAACGTATTAGGCCTCAGTGGC |
| ATGTAACTGTGATTCTAGTACTTGGGATGCTGAGGCAGGAGAATCATGAGTTTGAAGTT |
| AACCGGATCTTCAAGGCAAGACCCTGTCTCTAAATCATAGATCACAGGGGAGTGTGTG |
| TTTGTGTGTGTGTGTGCGTGCGTGCGCGCATGCGCGTGTACACGTGCGTGTGCAT |
| ATGTATGCATGTTCTCATTTTACAGCTCACAGAGGCTAGAGAGGAAACTGGGCCCAGA |
| GCCCGGTTCAAGCTGTGAACTGACAGGCCCCGTTGGCTCTTTTATTTGTTGAAGAAATA |
| TTTCCCAATTACTTTCTTGTCCATTGTGGATTCCACTGCAAGCTAACATTAGTAAAGGCA |
| TTTAAATAAAAGTCTGCCCAGACACAAACTAAGGCCACAGAACTGGCTGTGGTGCCCA |
| GGCGGGTCGTGAGGAGCCCAAATAACACTCAAAAGCCACCTTTATTTGTCCTTCCCCT |
| CTGCCAGTCACAGCATCATGAGCTTCTGGGGTGGTGTGTGTGTGGGGGGGGTGTTAG |
| TCTCACTCCTGTGGCACTGCAGAAGTCTCTCAAGGCACAGAGAGAGGGCAAGCAATGT |
| GTTCAAAGTCACCCAGAAACTGAGGTTAGATTGGAGCGGAGAGCCTCATCTCAGGAGC |
| TCATTCTGTCCGGTCCTCCCCTCAGATCACACTTCTGATCAAGTGGCACGGCAGACCT |
| T (SEQ ID NO: 138) |

FIG. 25 cont'd

Enhancer Name (Length) & Enhancer_Sequence mscRE1021 (1458)
AGAAACCTGTAATTTTCACATTCAAATACAATCCTGCGGACTTTTAATTAACCTAACTGT
TCCTACAATGCTTGCTGAGTACCATGCACCTGCAGGCCAGCACTGTGGCCTTGCCTCC
TGACGCACCTGCAGATCTCATCCTGATGCTCTACGATGAGTAGCTAAGGGAGAAAATA
TGCTTGCTGGCAGGATCCCCTTGGGGATAACTGTAGGCCGGTCCTATTTCATAAAATA
GCACACAGAAGTAGGAGACTATCGGTGAGTGGCAGGGAAAGCAGGCTTCACAGAGAT
GTTGAGTAACTACAGGATGTTTAGTCTAGAGAAGAAAGATTATGGGGACTTTGATGGTT
GTTTTCATCATTTCAAGAACTATTGTGTGACTACAAGGAGAATCTTGAGACCTACTGGG
GCTATTCCAGTTGGCCAATAGAGTGAGAATGTTAGAGAGAGATTCGTTTTGATGTCTTC
GGAAGCCTGCTCTAAAGGTATCTCTGCCTGTGAGCATTCCAGAAGCTGGCTGACCGCC
CGGCCTATAAAGAAACAAGTTTTTGCCAGTAATTCCAGTGAATGATCTTTGAGGACTCC
TCAGACGTTACTCCTTTTGTTCTTGTCCTCCAAAAGAAATGGAAAATAACAACACTTTCC
CTGGGTCTTCCTGACGCTTTCAGAGTGACAAGAATGTTACCACAGGGCACTGTGTGTT
CCCACCTTCCCCCACCTTCAATGGCCGGCCACTGCAGCAACCTTGACTTAGTTAACTG
AATCTGTTACAGTCAACAGACCTTGGTCCCAGTGACATTCTTCCTGCCCTGGTCACATA
CTGCTGAGCCTGTGAACCGTTACTAAGACCTCAACTGTGATTGCTTTGGCCCACCCAC
TGGACATACAAATTCTAGTGCTGAACAGAACAGTCAAGAAAGAGGGGGTATCTTGCCT
CAAGGTGAGGTAAATGGTAGGAAGACGTTCACAGAGCAGTGCCCACGAGAGGCAGTG
CACACAAAGGTTCCACGTACAGCCCACAGCTTGACGTAGGAGTGTCCATTCTCTGAGG
GAATGTCAAAGGAAGGGAGGTGCCTCTCAGTGCCCTGCAGCTGCCCTAATCTTGACTG
TGGCTGCATCTCCCAGGCTTTGCAGTCTAGACTACCATCTCCTGAACACCTGCTTTGTT
TTTTGGTTTTGTTTTTTTTTCGTAAAACTTTCCCAGACGTCATCACACAACTTGGAAAA
GAGCGTGTCTCCTGAGTTGCCATTTCTGTTGTCACGTTCTGACCAGCCAACGCTTGGA
AAACAAACATACAGTTCCCGTTGGAAAGACTGTGGTAATATTTCTTCACAGAAGTTTGC
TACCTCAGGAAACCAGTTACCTCTTTGTTTCTTGCTGGATACATGGTTTTGGCACCATG
TCAAACCTGCCTGAGGAATCACTGTTTACCTCAGAGGATGTAGCCTTGCTGCTT (SEQ
ID NO: 139)

mscRE1022 (987)
CACCTCATTAACTCCCAGGCACTAAGCTTAGATCACCTTTCTGTGGTGACCTTTTTAGC
TCCCTTCCCTTTCTCCAAGTTATCTTCCAGGGGAAGGAGCTAGGCCTGGTCTTAGGGG
ACAGGAGTGAGCCCCTTGGGGACCAGGGCTGGGCCCTTTGGCTGCCATCTGGCAGTA
CAGTCTGGAGCCTCCCAAGCCCCTGCTGTGAGGCCTCTGGGGTGAAAGTGTCTGTCA
GGCTGTGAGGTGGGTCTGTGCCCAGTTCACTCTGACTATCCAGAGACTTGGGCTGTTG
GCCTGGCTCGGAGAACGGGTTCTGCTGCCCTGGGCACAATGCAGAGCAAAGAGGAAA
GAAACCTTTTCCAAAGCAGAGGCCAGGAGGAAGCACACAGAGGCCTCTTTGCTTTGGA
ACCGAAGCCTTTCAGGTCTGTTTTCTTTAAATATCCTGCTACAGGAAAGAGAAGCCCAA
ATCCAGACATTCCTAAAACATTCAGGTGGCTTTAAAGCAGCAGTTTGTTTGATCTTCAC
CCCACCCTGTTTCTGCTCACTGGGGTCTCTGGGACCTACTCCTGCCTGGAGCTTGGTT
GGAAGGTCCACACCCTTCCAAGTTCACTCACATAGCCGATGTACCGATGGGGCCTGA
GACCTGATTGGAACTTGCTTTTTCTACTTTAGTCTGTTTTTGTTTTCGTCTGCCGTGCTG
AAGATCAAACTCTTGGCCGTGTGCATCCTAGGCGCTCACTACCACTGAGTCTCAGCCC
CTGCCCAGGTTTTGTTTGGTTTGGTTTGAAGTCACTTTTCTTTGATCCCCAGCTGTAAT
GGCATGGCTGACCACACCCTTTTCCTGGAAAGTCTTTCCCTTGACCTCTGGGGTCAGA
CACACAATGACTTCTGACTCAGTGCTCTGCCTCACTACTGATCACTAGACCTAAAGTCC
CATCATGAGGCACCTGAGGGTCTCCATCACTTCACTGGTCTTTAACCCAGAGGACT
(SEQ ID NO: 140)

| FIG. 25 cont'd |
|---|
| Enhancer Name (Length) & Enhancer_Sequence |
| mscRE1023 (683)<br>GGTAATGTAGCCCATATGTTTACAGGGTAGGCTCGATAAGGACGATAGATACATATACA<br>TCTACTGTGTTACCTGGTTCTAGGACCCACTTCAGTATAGGAACAAGACTAAACAGAAA<br>TTGGGCCGCATCCCATTGCACACTTCCTTAGCTCTCATCTCCTCTACTCCGAGACACG<br>GAGTGCTTTCCACAGCAACCACGTAGGTGGGAGCTGGAGTCATTTGAGGTCTTAGGG<br>CCAAGGCGGTGCTTCGCCTCAAGGCTATGCAGTTTCCAAGTCCAGACATCTGGATTTT<br>AGGGTCTATAATGGAAACTCAGTCGGGGTCATGGCCTCTCCTGGGAAGAGTCTCCAGA<br>ATTTTGTAACAGGACTTTCTCTTAGAGATCAGTGTGTTGTGGCGACATGGGACAATGTC<br>CAGGCTTCTGCTGCCAGATGTTGGGATTGTTGTGATCCATGGCTTTCTCCCAAACCAAA<br>TCATCCGCCCCGGAGTTTCCATAAACCTTTCTCAAGGGGTGTGAGCTACCAGAAAGAT<br>CATGGTGTGTCCTGGGTGCTGGCCTTTGAGAACCCACCTAGCCCTCTCCAGCCTCTCC<br>CTCAGGCTGGAGGCTGGAGGAAGATTATTTTTGTACTTGAGTAACTGCGTCAACCTTA<br>GGAGTAATAACTTGGCTATGACTCTATTTATTTATTCACAAA (SEQ ID NO: 141) |
| mscRE1024 (723)<br>CCCCAGGAAAGACGTCACAAAGTCTGTGAATACCACATGGAATGTGTTTAGCGTGTTC<br>CTTGTTGACCCTCTGAGATTCTTGAAGAGCATCCCCCAGTGATCTAAGTTCCTCACAGC<br>GGGTCCCACCTCCTGGAGGTTCCAGGACCTTCCAGTACATCCTGGGGACAATGTCTTT<br>AGCAGGGAGGTCTTGGGGGGACAACTAAGGTCTCAATGATAACACCACCCTTGGATTA<br>AATACGCAACTAGCCCACCTGGGCTTGGTCACTGAGCCCTGCCCCAGTCAAGACAAA<br>GGACTAATGTCTCCCAGAGGGCTTCAGGAGCAGCCCGCGAAGACGGACAGGCAGGG<br>CGGCAAAGCGAGCACAGCGCCTCACATCCGGAAAATTATTAGACTTGTATACTCTAGC<br>AAATTCTTTCCAGTCCACTTTTAGCCTGGCACTGCTCACACCACTGACTTTCAGGCTTG<br>AGCAGGGACATGAGCCAATGAAAACGAACTGTAACTCATGGACGCAGGGATAAGAGC<br>TCTTTGGGGGCGGAGCCAATGAAAAGGAACTGTAATTCCTGGATGGAGGGATGGGAG<br>CTCTCTGGGGGGCGCACCGCTGTGATGCACACGTGGTGAGTGCCTGGGAATTGGTTT<br>CACATGCATTTTGCCTGTGTGAAATACAGACGGTGAGGTTTTAGGTAGCAGAACACAG<br>CTTTCTCTCACTTCCTGGTTCATTCACCGAA (SEQ ID NO: 142) |
| mscRE1025 (373)<br>CCCCACAACCAGAAGCATGTCTCCCAGAGGCCAGGACGCATCGTGGAGCTGGAGTCC<br>TGGAGCCAGAATGAAGGAGAGTCCCCAAGCCTGGGATGTCACATGGCCCAGCCTTCA<br>AGCAAACATGTAACACCCACTTGGGACTTAGGAATCATTAACTGGCTCTGTGGCTTGTA<br>AAATAAATAAATAAATAAATAAACCTTCCTATTTGTTTAACCTCTGGAGTTTTCAGTTTCC<br>TCTTCTCAATGAAAATGAGCCAACCTTCCCACTTTTTTTTTTTTAAGCAGGGGACATTGA<br>AACATACCGTTCTTCCTCTCTGCACCAAAGAAGATCAGGAAGTGACTTTTTCCCATTAT<br>GAAATCTCAGTGATGGCCCA (SEQ ID NO: 143) |
| mscRE1026 (329)<br>GTTGCGTCTGTCAGGGACAGCTCTGGATCCCCAGAGCCAGATCGTGCTCTGTAGCTC<br>CCTTAGGAGCAACTATCAACAGATCCATGACCAAGAGGGCCCCAAGATTCAAAGACTG<br>TTCCAGTCTACTCTGGATTTTTCCAGCTGTTTTTCTTGGCCAGAGGATCACACCCATCG<br>GGATGCAAACCGAGAGCAGGAAGCAAGCGGAACAGTAAAGTCAGATGAACCAGAGGA<br>GAGGCAGATGTCACGGACACGAGGACGGTAGCTTCGAGCAGCCCAAACCCTTGCAAG<br>AGAACACCCAGAGGGGGTATCTTTTCAAGTGCAGGTTGTGCT (SEQ ID NO: 144) |

| FIG. 25 cont'd |
| --- |
| Enhancer Name (Length) & Enhancer_Sequence |
| mscRE1027 (325)<br>AGGGAGACACACACAGACACACACACACAGAGAGAGAGAGAGAGAGAGAGAGAGAGAGACAGA<br>CAGACAGACAGACAGACTGACTGACTGACTGACTGAGGGAGCAGCTGGAGCTCAAGC<br>CCCAGCTCATGTGGAAGTATCCAAGCTGCTGTTCCTCGTTTGGTTTTGGCATGAAGCA<br>CTGTAGTGTAGTAGTGGAAAGAATGGAAGCGATGCACTCTTCTGTTACATCTAACCACT<br>ACATTAAAAATGGATATCCTGATACCTGACCCGAGGCTTGACACAAAACAGACTCACTT<br>TACAAGCACTGCAGGAAATCTCAGAAAAGTGGAGA (SEQ ID NO: 145) |
| mscRE1028 (194)<br>TCGGTCCGCAGAGGTTCCCTCTGGGGTCAAGCCCTCCAGGCCGATGTCGCTGTCCTG<br>CGCGTCCTGCATGATGTGTTCGCTCCGGACGCCCTGGGTCCAGCAGAGGGACCGGCA<br>GAGGCGGGAGGAAGGTTGAGCCCAGCTGCCTGCACCGCGCTGCTCCGCCCCCGGCG<br>CTCTAGTCCTGGGGTCCCCCAGTT (SEQ ID NO: 146) |
| mscRE1029 (625)<br>CTGGTACATCTGTGTTACTGCTATGTGAATGAGCCCTGTCTGGCTGTGGCATCTGCAG<br>AGCTCAGCTACTGCCTGTCTGAAAGTTCTTAATCATTTTTATTTTTAGGTTGTGTTGTTTT<br>GTTTTGTTTTGTTTTTGTTACACAGTTTTGGGGGAGGTACCATGTGCTAGAACTACTTCT<br>AAGAAAATAATTAAAGACATAGTTTCTCTGGACAGAAATTTGATCCTATTCTTTGTGTTT<br>GATATGTTTTTATTTAGTTCACGAATAATAATGGATCCTGGAAGCATGTATCTAAGTAGA<br>TTGAAAGGTTCGAAAATCAAATTTTGGAAACGATCGTTTACCTCTTCCTTCCACAGAAG<br>AAAGGCTACTGTCTTGAGGACAGCTAAGTGACCACATGGGCTTGATTACTGACCACAG<br>AGCCAACAACTGCTTGTTTTGGCTGCAGCTACTTCTATTTTAGCTTTGACAGTACACCC<br>CAGAGACAAACTTAAAAAAGTTAGTGTGGGAACTGAAAGGCCACAGTTTCTCATTGTTT<br>GCTCTCACCCATTGAGCCCTAAGTCAGGGTGTATGAAATCACTTCACAGTGGTCAGCA<br>CAGCAAATGGACAAGGAAAGCTCTGGTGGGGGG (SEQ ID NO: 147) |
| mscRE1030 (492)<br>TGAGAGGAGAGGAGAAGGAGGGGGTGGGGAGGCACCAGAATTCCTCTCTGCGCTTCTG<br>GAAGCACATTCCTACCGTCGTTATGAGCTGACTGGGGATTTGGGAATTGACTGCCAGC<br>ATCCTTGGATCTCTCTCTTCAGCTTGGCCACTATTCTGACCCTCGTCTCCCCGGTGGAT<br>TCTTTCTGGTCCCTGTGAAACAGAAGGGCTGTGGACCTAGCCCCTCCTATAGCAGGCC<br>TCCTGGATTACTTCCTCCATCTGTTCTGCCTCCCACCCTCGGGTCAAGACGTCATCGTC<br>CTCAGATCATCATTTGGTCCAAGGATTTCTCCGTGATGCTCACAATTGTTTACTTTCCTC<br>TGTGCTCCTCTTCTGGCCATTCCCCGGGGTCAGCTTTGGACTCTCTGGGGACAAACCC<br>TTCCCTTGTCATCCTGTGCTTCCCACACCCACGAGGTCACCGTTTCATGGACTAAATGG<br>ATAAGTGACAAGGACAATGAAGAG (SEQ ID NO: 148) |
| mscRE1031 (625)<br>GGTGTCCTGTGGGTGCCTTGAGGGTAAGAGGCTCAAGAAATCTTCAAAGTCAGACTCC<br>ATTCAAGAGCTGAACTAATGTTGCCTGCCACTAGCGACATTAACCCTCAGGGAGGGTT<br>GGACAGGATCTGGGGAAGCTGCAGGTGCAGAGTGCACTAGAATTTGAACCCCAGGAT<br>ACAGACAAGAAGCTGCCTAAAGGCAGAGAGCCCTGGGTACCGTGGTCCCAGGAGGCC<br>AAAGCCCCGGAGGTCACAGAGCTGAGCTCATTCTTCCTCTCCAGCTGCAGATGTTGTA<br>AGGGAAAAACAACAAAACAAACAGGAAGTTCTGAGGATGGTTTCCCACGTGTTTCTCT<br>CCATGTTTCTCTCCAGTCACTGCCTCGTCACCCAAACCAGTTTTCTCCTCTCAGCCTCT<br>TGTGCTCCCAGATCAGGCCTCCCTCCCTCAGCCCAGATGTCCCCAACGGGGGTGGGG<br>GGTGGTTTATGCTTCGCTTCTAGGATGCCTGCATCTTAGAAAGGCAAGGTGGCAGGCT<br>GCACAGGCAACTGCATTATCATTTCTTAATGTCATTTTTTTCTGATCCGTATGATGGGG<br>GAAATGTGCTGGGTGTGGCTCACTCCTGTAATCGTAGCACTCAAGA (SEQ ID NO: 149) |

| FIG. 25 cont'd |
|---|
| Enhancer Name (Length) & Enhancer_Sequence |
| mscRE1032 (423)<br>CTCTCATGTGGGATTGCTCACAGTTAGCTCAAACCTTACTCTCAGACTTCAGAATCCCT<br>CTTGGACAGAGCAGGAAGGAAGACCATAGTATGTCCAGCTGTACAAATGGAACACAGA<br>CTTCTGATTTCCCATCATACGGCTAACTATAGAAGCAGAGGACACCACACTGCGTGAC<br>ACTGAAGCTTCTGGCCTTTCTCCCATGACCCCTGCTTCCACATGTCATAACAGTCCCAC<br>AGCTGGAAACTAGATGGTCTTCAGATGGCTCTCTCTACCCAGAGAACATCATGCTGCA<br>CATTTCCAGGAGAAAAAACCAGAAGTATGACAAAGAAAAACGACAGGAGATTCCTTCA<br>GAGTACAGACTCCTCTTAGAACAATGAAGATGTTTGACTAAAGCACTCCAAGTTACTTG<br>TGCAATGTGTTGTT (SEQ ID NO: 150) |
| mscRE1033 (359)<br>TTAGTTTTCATATAAAGAAACACATTTGCTTTCTGCTCTAATGGTTCTCTTAGGAATCCT<br>GAAGTTCTCAGGAGAATCAAAGCACAGATGTGAGACAGCAAGTTATACTTTCATTCAGG<br>AGAGAAAAACTTGACAGCCAAGAGAAAAGGAAGCTGCTCTGGATTCCTGTCTCCTGCA<br>GCTGGGAAGTTTTGCAAAGGTCCCCAGGGAGGAACAGGGCCACCAAAGGCTGAGCAA<br>GAGTGACTCGGGAACATTCTGAGTCAAGCAGGGACTGGGGACCAGAATGCAAGATAA<br>GGCATGGAATTAGCGGAGGCCATTTCCCTTGCTTCTCAGGGACCTCCTAAAACACATA<br>GTCCAGGAGG (SEQ ID NO: 151) |
| mscRE1034 (661)<br>CAGCTGCTTTTCCTGAAGGCAGCTTCAGCTTTTCCAAAGCCAGGGTGCTGCTGTGGTC<br>AGCTAGTGCTGCACTAAATATCCTCTTCCAAGGGGCTCTGATCCTGGCTCCAGCCCCT<br>CTGGCCTCTGGGACTGGTTTTCTCTATTTCCTTTCCTTCTCCAAGGTTAGCTTTTCAGA<br>CTCAACAACATAAATCAAGAGCCTCTAGGGAGGTGAACAGAACTGGCCGGAGAGGAA<br>GCACTGCTTCAGTGGGGGAAGGGGAATGTCCTGGACTAGCAGGCCCCAGTAGGGGT<br>GGAGTGTGGGGGTATGGTGCATACTCAGATGTCTCCTTGGAAGGAGTGGGTGGCAAG<br>GATTCTTCCATAAACTGATAAGCCGGGACACAGAGTCCCATCCCCCATCCCCACCCTG<br>TTACACTGCTATAAACAGAGAGGGCTGAAGGCAAAAGGACCCTGCTTGCTGCTGCAGC<br>TGGTCCAGTCTAGGGGGCTCTTCAGTAGAGGACAGCTCTCTTCTTGTCACGTGCTTTC<br>CTCTCTGAACAGAGCTGGTTGTTTTGGGGCACTTGGGCTCCTGTGGACTAATGGGGTC<br>AAGGACCAGGCCAGACACACTAAGGCCTGGAGTCCCTGGGGACTAGTGGTTCCAG<br>TTCACTAACCTCTGCCCTTCAAATCTG (SEQ ID NO: 152) |
| mscRE1035 (477)<br>CGAGACCTAAACAGCCGCCGTGGAGGTCATAGTCCTAGTCAGGTTCCTGCGCAGAGG<br>CCCTAAGCTGCCGAGTGACAAGCAGAAGGGTGAGTGGAGGCAATGACAGTCATCTGG<br>CAGGGAGGAGGAACGCCAGACTCCTTGGAATGCTGTGGTGGTTTTCTTTAAAGTTGTT<br>CCCCATGGGAATCAAGGCAGTCATCCCAGGGGGTGGGGGGAAAGGGTTTAAGACTTC<br>CTTCCTCAGAAAAGGACACTGCTACTGTACTGCAGCTGCAAGGGAATGCCTGCTATGT<br>TGTGGTTGATGCTGACCCAGGATGGAATGCAGATGAAGGATGCTTTTAGGAAACAAGT<br>CTGCTTGGAATGCTGGGTGGCAATCCTTAGCTTTTGGTCGAGTGGAAGCCTGGCCTCA<br>CTTGTCAACAATGAAAACTAGGTTGGTTAGAACCTAATAGACTCCCTGGCTCCTGCCCC<br>CCATGCTCACTGTTA (SEQ ID NO: 153) |

FIG. 25 cont'd

Enhancer Name (Length) & Enhancer_Sequence mscRE1036 (667)
GGGTCTCCCTAGCCCAACCCAAAAGAGAAAGGATGCAGGAAGGATGTGGAGAGGGAG
GCAGGAATCGGGCCAGAAGCACCCTCAAGTCCTCTCCTCCCCCCTCCTCCCTCACTTC
CACTTGAGGAGTCCTCTCTTTTCTCTCTCCCTCTCCCCTCCTCCTTCCTTCCCAGTCCT
CTCTCCCCTCCCCCTTCCCTTTTGTCCTCCCCCCTTCAGCACCCCCTCCAATTTTCTCT
CCTACTTCTCTCTCCCCTTCCCCTCCCCCCTCCCCCCTCCTCCCTGTTCTTTCTCCCTG
CCCAGGCCCACTGCCTCCCCTAGCCCCTGCTCCCAGAAAGCCCTGGAAAGGCAGCTT
TCTTTGAGACAGGAAGGTGTCCTCAAGTCTCAGGAAGGAAAAACAGTCGAGCTGAACC
CAAGACCGTCTCCAAGGGGCTGGGGCTGGCTCCGGGCCAGGGCTGACATCACCTGG
GAACCACTGCCTCTGCAGCTGCAGCCCGCCTCCTGGGGGGATGCTTCTGCTATTTAAA
AAATAATAATAATACTAAAAAAACTTTTCCAGTCTGGTGTTTTAAATGTGCTTTATATAG
TGGGCCCTGGGGTGTGGGAGATTCAATCCCCTCCCGTTTGTCCTCACAGCCCGGGTT
TCTCACACCGCACTGGGCAGCCTTCCGA (SEQ ID NO: 154)

mscRE1037 (642)
AGTAACTTCATTTCCCTCTCTAAATTTGGGTTCCTTCTATATCTGGCCAATGGTCATTTT
CAGAAAAGAAGGGCAGTCCTAGCTGCAGGAGCACTTTAAGGAGTTGTTTATTATGAGT
AACAGATGTAGTAGGAGAGGTGAGACTGAGTACAGACCTTTCTAGACATTTTCTACAAG
AAATCCTGGCAGCTGTAATTCCCTTAGGTGGCTGGTCATCATCAGAAGGCCTCTGAGA
GATGATCAAGAGGTCAATTTTGACAGAAAATGGTAAAAATTTGTGGATTGTCCGTATTA
CTTCCCATTCCTGACAACTGTTCCTTCTTAAAGGCCAGTTCTGAAAGGTCAGAGTGTGG
AAATACATGCGCCAGAAAAAGGCTTGCAGCAGGGCTTTTTACCATAAATGCTGCAAATT
AGTGCTTCAAGGTCCCAGTGAGAAAAGACCTTTTAACTTTCTCTGCTGTTGACATCAGG
ATAATAACTGTGGGAAGAGTGGAAGGGCAGATCCTGTTTAAAAAAGAAAATTGGACCTT
CAGGGAGAAAAGGAAGGATCTTCGTATCCTTTCCCACAAATGCAAGACAATTGTCCTA
GGAAAACACAGCCTATGATCACAGCACAGCAAGGCAAGTTCCCAGAACATCTGA (SEQ
ID NO: 155)

mscRE1038 (548)
GCCGTATCTCATTTTTAGACATTTAAGTTACTTCCAACTTTTCCTGCTTATCAGTTACGT
CAGCATGGCTATTTTTATACCTAGATGGCCTGTGTTCCTGACTGCTTGGAAGTAGACTT
ACTGGGTCAAAGGGGATGCCAGTGTGATTTTCAGAAAACGATGCCCGTTTCTGTTCAC
AGCTGGTTTCTATAAAGCATGGGAACGGCGCAGGCACTATTTATGTGCCCTGCTGAAT
TCTCAGCTCCCTGCTTCATCTGACCTTCCGCCACTACTCAGAATCGGCTCTGTTCTTCT
CCTGGGCTCCCGATGGGAGCCAAGCTGGACTTGTGTCAGTGTATTAAGAAGTGCTCGT
TATAGCTCATTGCCCATGGGATGTCGACTGCTGCTGATTTCTCAGGGCTGGAGATGAC
ACATTTTCTCACATTCTTCAAAAGTCTTAAGGTTCAGCAGGAGAGAAGGAAGGTCCGAG
CCAAGGAGAGCTGCGGCCATACCGACAGGGAGGGCACTCTCTCTTTCTCTAGCTCTC
CCCCCCCCCCCTTGAAAAGGGG (SEQ ID NO: 156)

FIG. 25 cont'd

Enhancer Name (Length) & Enhancer_Sequence mscRE1039 (707)
GCAGGGCATGGTGGAGCATGCTTGCAATCTTCCAACTTAGGAGGCAAAAGCAAGAGG
GTCATCAGAAGTTCAAGTCCATTCTCACCTACGTAACAAACTTTATGCCTAGGCTGGGT
TATGTGAGACCTTATCTCAAAATAGCCACTCATGTAAACAACAAAGAAAAACCCCAACT
GTTTAGGGAACTCTCACGCTTCAGGAGCCATACCGAAATAGGAAGAAAATCCTTGTGG
CACAGTGTTTCTGGACAGATGTGAGAGGAATCAGTTGAGACTAAGCTGACCTTTAGTTT
AGTTGCAGCTGGAGCTCAGATTCATCGCCTGAATATTATTTAACTAGTTTCCTGGCGAA
GAGCTTCCATCCAAGAACTAAACATGTTCTGCGCTGAGCATGAAAGACCCAACCTTTG
ATTAATCTTTCCTGTTCAAACTTTTCACCACTGCGGAGCACTTCCCAAACACAAGGGTT
CTTGGAAAAGAGACTGCACACTTGGTTAAGGAGCCAGAGAGGAGCAAACTGCAAATGC
TTGAAACAGCACCACCCAAGTCCCAGCTCCCTCTCAGACTCCAGGATTTGGAATGCTA
ATCTGAGGACCTCCTTCCACCATGGATGACAGGCAGAAACAGAAACCTAATACAGTCA
CTCACTGAGGTAGTAGGACACAGCATGGTTTTTTTTTTTTTTCCCAGCACTTTCCTTAAC
TCTTT (SEQ ID NO: 157)

mscRE1040 (485)
TCATGAGGAACAACTGAAAACTGTTTGTTTCCCTGAATCCATGACAACAGGAACTTAGT
CCAAAACTCAGCCATGAATGTTGGTAACGTGGGCACTGCAGCGACCTGAAAGAATTCG
GGCCCGGCTTGCATGTTGAACACAGAGTTGCCAGTGGCATACTTTTTTGGTAGAGAGG
AATAGAAAACCCTGGCTTCCTCTGAGAATTGAATGCCTCCTCCCAATGCAGTCCAAATT
CCACTGAGAACCTTAACCTTATAAGGGAAGGCAGCTTTTGAGTCACAGGCCTTTGCTG
TTTCTTTCTCACTGGCTGGCCTGGAATGAGCCTCTGCTAAAAATGTTCCAAGCAGCTAT
TGACCTAGACATTTCTCTCTTCTTTTCTAGCAACTTATATGTGTGTGCTGAAAGAATGCT
GCACGTTCCTGTGACCTCACTCACCCCTCTGAGTGCCTTCTTGGAAAGGAGATGTAGG
TGGAGGGTTTCCCAGA (SEQ ID NO: 158)

mscRE1041 (523)
TCCTATGAGAACCACAGTGTCATCCCATCTAATGACTGACAGCATCCATCCATGATTCC
TGGAGAATGGGCCTCTGGGTGGGACTGAGGCAGCATCTCTTTCATGTGTGAGAATGG
ACTCAATGACCTGCCAAGGTCTTTTTCTGGTCCATGGCTCTGGGTACAGCTGCAAAAAT
AAACTTATGGTTACAGCAATGGAAACAGGCCTGTAAATACAGGTCGCCAGGACGCAAC
TCTGTGACACAGGCAATGACAAATTCCCAGTGTGCATTTGCGTGACTTGCACATTCTCT
CTGGGAAAGCCTGCCCTGGGATCCTACAAACAGAAATGTGGGAATACTTTTGTCCAGT
GAGTATAATGCCACAGGCCAGACTTGATCTTCCCTCCATGTTCCCTCGACATTTTGGCC
AGAGACCAATATATCTTTAGTAATTCCTCAAGACCCATGGGAACTGAATCAAGGGAGG
CTCTCCACATCACACACACACACACTCACACACACACACACACACACACACA
(SEQ ID NO: 159)

mscRE1042 (474)
CCAGGGCGGTCCCAGGCCTCAGAGCTCCAAGGGACGGGAAGTACCCAGTGAAGCAA
GGGACAGCCCTGGTGGAATAACTCCTTCACAGCTCCATCCCAGAAGTCAGCGGCCAC
CCAGGGCAGCTGGTACACCACAGTGACGAACCTGATTGCCAGTCAGCCTGGCAGCCA
CAAGAATGGGGTAATTCTACAAGGACCAGGGCCAGAGCTGTCTGTAAGGGGTTAAAAA
AAAAAAAAAAAAAAAAGGACACTCCTCGGTCCCCAGGAGTTAAAGGGAATCCTGGCAAG
CCACCCAGGAGAACTCTCTGGAGGCATGTTTGACTTTTAAATTCCAAACTCTAGCTGCC
CCAGTGCTTCAGAGAGATGTTGCCAAACGAGTTCAAAGAGACATGCATGGGTCAAACA
GTAACCACTCTACAAGAGAAGCTGCTTTGTGTGTTCTGAGGTAGCTGATAACATGGAC
ACAGGAATACTCT (SEQ ID NO: 160)

| FIG. 25 cont'd |
| --- |
| Enhancer Name (Length) & Enhancer_Sequence |
| mscRE1043 (455)<br>CATCGCACAGCTTAGCCTGTGGCCCCCGGAGTTTGGACAGTGTCCCTGAGAGAGAAG<br>TTGAGGTGCTGGTACCCCGTCCAGCCTGCCTGTCCGGCTGTCCTGCTCCTGCCAACC<br>CAGGCCTACTCCCAACCCCCCACCACCACAGGCAGGCAACTTGGCCCTGGGATCGGT<br>ACAGTCCAGTACACATGTCTTGTCAATCACAACTTGCTCAAAATAGTTGCTGGCTGCAT<br>TTTCCCTCCCCCAACTGTGTTACTCCTAGAACTAATTATAGTACAAATTTCTGCCTTCCA<br>TGTCCCTTTTACTGCATGGACCTTTTAGTCAGGACTCAGTATCAGATCTCTGGGTTTTTT<br>AACTAAGTGATCTATCAGGCACCATGCCTTCCTCCAAGGATCATGAACCTAACTGCTTT<br>TGGCCAAAGTCCATCGGAAAGTGACATCAACAGAGACTTCAGTCTC (SEQ ID NO: 161) |
| mscRE1044 (518)<br>CCTCTCCTCCTCTTTGTTTTTCTTCTGCTGGCACAGGGCTGGGAGAGCCAGTTAACGC<br>AGATGGTAGTGCAGAGAGTTCTCATGACCCCGGTTTTATTAGCTGGGGACCAGGACTT<br>TCTAAATGTGCCCGTGTTTGATTGTATACTCATGTTGCCTGATTTAGCCACATTACTTCT<br>GATTGCTTCTTAGTGATTTTCCCACTGAAATTTCTTTCCTATTGGTTTTGTAGAGGTATA<br>GTTCACTCCCATCTCTATCTGAATGGCATTCTCCAACCCGAGAAGCATGCTGGGAACG<br>TGGGCCAGGGAAAATGCGCTCCCCCATGCCACCATGCCCGCCTGAAGCCTGTGGTTT<br>CACAGAGGATTCTTCGGTAGGCGCTGCTTGAGTTGTAGTCTGATGACGGTGACGCTTA<br>TGTTCCGGCTTCCCTACAGTAACTCTTCTTGGCTGATTATTGCTAGAGAATCTCATTGG<br>AGGAAAGAGGAAAAGACGGAAGCTGAGACCTGTTTGTGCTTCCCCTGAAC (SEQ ID<br>NO: 162) |
| mscRE1045 (367)<br>TGTGTCAGGCTGGCAAGTTAGTGAACCTCACCTCCCGGTCCCTGCTACCCTGGCTTCC<br>AGTGTCCTGCGGCTTCTGCCAGCCTTTGCATTTTTCTCTTTTTCTCATTGCGTGGCCCC<br>CTTGTCTTTAAAAGGCTAAACTGCTCTGTACTAAATTTGGTCACGCAGCGCTCCAAGAT<br>TCCCTGGAATGTCCTCAAGTTTCAAACAGCTCTGACCGTGAGGCAGGCCCGCCCCCTG<br>GCTTGGGGATTGGCTTCTCCTCTGTGGCTGGGCAGCTGTCAGGTTTTATTGGTTGCTG<br>GTTAGACCAAGCAGGGTCCACTAGCAGGGAGGCTGCTGTGTCCCCCGGAGCACCTGT<br>AGTACAGCAGGGCCCAAA (SEQ ID NO: 163) |
| mscRE1046 (388)<br>AGGAAGGCTGGGGTTGTCTTAACATAAACACAGCTTAAAGGAACTATTCTCAAATCTCT<br>CTCCTTTCTGACCAGCTACCTAAGTCATCAAGACAAACTCTTCAACTGGCAGAAAGCTG<br>GCCTAGCCTCACTATGCCTCCCAGCACACTGCCTTCTGGGGCAGCAAGTGCCTGGGA<br>ACATCGTAGAAGCACATTCCCAGGACCTGCTGGGCTAAGGCTTCACCTCACATGGTCA<br>CCATCAGGCCGGGTTCAGGCCCCTCGGGGCTCTGCTTTTAGCAGCAATGGGAAAGAG<br>GCACAGGGTAAGAGAGTCAGAGGGCGATAGGCAGGTCTGCAAAGCAAACACTCAGAA<br>AATTAGAAATAGCTCAAGAAACAAATGCCCTGAGAAAGTAT (SEQ ID NO: 164) |

| FIG. 25 cont'd |
|---|
| Enhancer Name (Length) & Enhancer_Sequence |
| mscRE1047 (662)<br>CATTGTGAAACACACCACACATTGCATGGCAGCCCCAGCAGAGTCCTAGGTATTCCCC<br>AAGGACCAAATGTACTAATGTTTTTCTGCAGAGAAACATAGGACAACTCACACGCTAGA<br>GAAAAAAATTACAAAGGTTACAAATAGCTTTCTCTCGGGATTTGCTGCCAGACCAGTTG<br>AGAGCATATAAGGTCAGGTTCTTGCTCTGCAAGGTCCCAAGTTCCAAGTTTTGAGAGG<br>TTTGGGATTTTGCAATTGGGGGTAAAAGGGTATTGACCCACTGTACAAATGACTTTTCC<br>CTGGTATTCCCATTGGGTCCTAGCACTTACTTCAAAGACCTTACACATTCTCGGGGGG<br>GGGGGCCCTCTGCAGGGGCAACAAGCACCAGTTTGTTACTCCAACAGCAGAAGCCAT<br>GGGAAAATTCCTCAGAGCAGCAAAGCTGCCCCTTCCAGCTCTCTGTCACAGAGAGTGC<br>TGCCCTTTCCTGCTCCTAGGACGCGGCACTTATGGCCATGATGACATCATCATTTAAGA<br>TAGTCACTAACTGACCCACACTGTTACCATCCTGACCCACTCCTCAACCATCCTAGTAA<br>ACCTCTCTTGATAATGGATTAGGCAAAGAGAGTGTACTCCGCTGTTACCCAGAAACCTC<br>AGGGAGAGAGAGATCAAAT (SEQ ID NO: 165) |
| mscRE1048 (442)<br>TTTTCTTCCAAACGGCTATGTGTCTGTACATGGACTAACTTATATGATCACCTGTCCAGA<br>CTCACAAGCCTTCAGCCCTCCCCAGCCTCCCTACGGCTGCCACACTGGCCAGGAGGG<br>GCTCTTCTGGGCAATCTGGCCCTGGTCCCGGCAGCATGACGCTGAGCAAGGCAGGGG<br>TGTGGAGAGCTAGTCTGTGTACCCTTCAAGGGCAGCCAGAGACAGGAGGTGGAGCCT<br>CAGCTGGCCAGCAGGTCCCACAGGCCACTGTTGCAGGGCAGCAGGTCACATGCTAGG<br>CGTGCTTTGCGATCCCGGACGGCCTTCAGGGCTGGGCTGTGTTGTAACAGGAGGGAG<br>CAAATGTCCTCGTGACCCTTCTCCGCAGCCTGGGGGGGGGGGTTGTGGGGGGGAGG<br>GAGGGAGAGAGAGAGAGAGAGAGAGAGAGAGAGAGAGAG (SEQ ID NO: 166) |
| mscRE1049 (516)<br>AAATTCTGTGTTGTAGAGTTTATTTTCCTTCAGTGTGATAGTCAGGGTCTGAGCCTGCC<br>TCACAGTGAGCATGGAGGGCAGTTACAGCCAGCATGGACGACCTCTGTCCTGACTGG<br>AATGTGGCTCTGGAAGGTTTTTTTTGTTTGTTTGTTTTTTTGGCTTCTGCTTCTATGCCA<br>CGACTCTTGTACCCAGTGTAGAGAACTTGGTGTTTCCCCTGGGGGTGCTACACATCAC<br>CCCTCTCCTAGATTCTGGCCTCGTCCCCTTCTCAAGGTCATCAGCACTAGGGCAGGCT<br>TCTATTTAACCTTGGACTTAATTCTAGAAGCCATGCCTCTCCCTTCTTGACTTGTTGCCA<br>TTAAAGGCACTTTGCAAAGCTTCTTCGGTTCCCTGGCAATCTTGCAGCAGCCTGGGGG<br>AGCCCTTGTCTTAGCTGCTCCTGCCTTCTGCCCTCCTTTCTCTAAAGTTTTCTTTCTCAG<br>CGCCCTTCTCTCTGAGACAAGGCTGCTCTAGGGCAGTCCTCCCCTC (SEQ ID NO: 167) |
| mscRE1050 (492)<br>ATTTTTACTTGATTGTTTGCCTACTGAATCCAACCAGTAAAAGTAAATATTCTCCCTTTT<br>CCCCGCTGGAGAGAGGCAGATAGAACCAGTTCTAGTCTGGGAACTACTTCCTGGTTGC<br>ACAGGAGCCTGCTAGAGCCTCCTCCCCGACTCAGCTGGGCACAGGAAGGTGGCTTC<br>GTCCCTAAAAGGTAGCGCCCGAGGTCTGGTGAGGACACAGTGAGCTGGTTGGCCATG<br>TGAAGTGAGCCAGAGGAGGAGAAGGTTGAGGTCGCTGGTCCTTAGCTCTGACCTGCT<br>GTTCCCGGTTTCCTTCAGCCAATTCTCCCTTCGATTATTTTTAGCATGGAGCAGCGGAC<br>AAAGGCAGTGGGCCAGCAAGGGAAGATAGATTTCTATCTTAACCAGGCCACTTACACG<br>GGACCTCTGTCTTCTAGTCTGTAGAGTATAGTAGATAGTCCCAGCGCTTTACCCTGTCA<br>CTGTTAAAAACACTATGACCTGCACA (SEQ ID NO: 168) |

| FIG. 25 cont'd |
| --- |
| Enhancer Name (Length) & Enhancer_Sequence |
| mscRE1051 (378)<br>CAATGTAAATAGACAGTGACTATCCCATCCTGTAGGATGGTGGGAACTGGCCAAGTCT<br>TTTTTCTTCCCCTTCTTTCCCAGTGTTTAGGGTCCTTCAGAGAGAGACACTCAGCTGCC<br>CAGATCTCCCAGGAGCCTGCTACTGGCTCTGTCCAAATAAGCTCAGTAAACAGCCCCA<br>GGGTGCTCTCTCTAGCTCGCTTGCGCTCTCTCTCTCTCTCTCTCTCTCTCTCTCTCTCT<br>CTCTCTCCCCCTCTCTCCCTGTATCCCTCTCCCCCTCCCTCCCTCCCTTGTCAGAGTGT<br>GTTGCAGCTTTTCAAATGCTTAGACAAACATTTCCTGTCCTCAGGGGAGTGATCTGAGC<br>TCTCCTGAGGTCCTGACCATTGCCCA (SEQ ID NO: 169) |
| mscRE1052 (377)<br>GAGAAGAATGGCAAGTGTGTGAGAGAGGGCAAAGCAGAAAAGGGCCAAGCGGGTCCT<br>CAGGGAGAAGCCACAGCCCTCTCCAGCCTGTGCTGTCCAGGAACAAAGCTGCCCTAG<br>GCCTCCCCAGGGGCTCACTGGCCGGTCTCTGGGTTTCCCCGGCTAAGAGCTCCCGGC<br>ACAGGGGAGGAGCCGGGAGTGGGCGGGGTCGTGAACACGGGCTGGGGCGGGGCTA<br>GAGGGGGAGGGCTCAGCCTTAGTCCCTTTGGGTGTCTAGAGGGCGGGGCCTAGGCT<br>GATGGAGATCCGTGACCCTAGAGGATACACTCTGAAGGAGGTCAGGGCCACGACAGA<br>GAAGGGGAGGAGGCAGGCGGCTGTGCAAATAAAGGTTT (SEQ ID NO: 170) |
| eHGT_641m (623)<br>AAGCATGAATGGCCTCTCAGGATGGAAGGGGGGCGGGGAGAGAAGAAAGCCGGTCA<br>GAGGCAGCAGTTGCTTTTAAGAATATGTAAGATTTCTAGTTTCTGAGGTGCTGTGTTAT<br>AGCAGCTTTAAGCAAGACCTAACAATTTGTTAAATACTTCATCTCCAAACAGTGGTGGG<br>TACTACAGTTTCATGAGCAGCAGATAATAGATTCTGTTTATTCGCCAACAATACCGACA<br>CTGTTTCGCCCCGGACTGCAAGTGGCTGAGCCATCTGGCTCCTATCTCCACAGTAAAA<br>CATTGTCCGTGACACAAAAAATGACTACATCCCCAGGACAAACTAGTGTGACCTCTAAA<br>TAAAGCCTTCCTCTGAAGCTATGATATCACACTGCACAGGGGACACCAGCACAATTGA<br>ATCTGGTCACCAAAAGCCCAAGTGAGATAGGACTATGTAAATGGGATTTTATAGGAGA<br>CGTTTTGTCCTCTGTGCAAACCATCGAGATCCGTCCACAGCACTGAAACATCTTTTTCA<br>TTCACCCTGAGGACAACAGTGTGCTTCTTTCTGGGGGGTTGGCAGTCCTCTTTCTCCG<br>GCCCCAGGCCGAGGAAGCACACATCCGTGTCCCAGAGGTG (SEQ ID NO: 369) |
| 3xCore_eHGT_410m (608)<br>CACTCTTCCCTTTATTCTTTCTTCCAGGCCTTTTAGTGTTTGCTTAATCAGAATATTTTAA<br>TCTCTAATGTGGTGACTAGATGTAATTTATCACATTAAGCCTCTCCTATTTTCTTCTGCT<br>TACATGACTAACGTTATTGTGTTTTTATTGCGCTTATACAAACAAGCCTTTCCTTTGTTC<br>CATTGTTTCAGCAATAGGTCAACACTCTTCCCTTTATTCTTTCTTCCAGGCCTTTTAGTG<br>TTTGCTTAATCAGAATATTTTAATCTCTAATGTGGTGACTAGATGTAATTTATCACATTAA<br>GCCTCTCCTATTTTCTTCTGCTTACATGACTAACGTTATTGTGTTTTTATTGCGCTTATAC<br>AAACAAGCCTTTCCTTTGTTCCATTGTTTCAGCAATAGGTCAACACTCTTCCCTTTATTC<br>TTTCTTCCAGGCCTTTTAGTGTTTGCTTAATCAGAATATTTTAATCTCTAATGTGGTGAC<br>TAGATGTAATTTATCACATTAAGCCTCTCCTATTTTCTTCTGCTTACATGACTAACGTTAT<br>TGTGTTTTTATTGCGCTTATACAAACAAGCCTTTCCTTTGTTCCATTGTTTCAGCAATAG<br>GTCA (SEQ ID NO: 370) |

| FIG. 25 cont'd |
|---|
| Enhancer Name (Length) & Enhancer_Sequence |
| 3xCore2_eHGT_390m (750)<br>GAAAGGAAAGAGCTTGCTTTCAACCTCAAAAGCTAGGAGGAAAGGGCTCTGAAATTTG<br>CTCAGAATTCCCAATTCACCATTAGCCTGTTTCTTCCTTTAGCCTCAAGGCATTCTCCG<br>CTTTTTGAAAAGATGTTAAGAAATTCAGTCACAATAGAGAGCCTAGTTTTGAACATGTTT<br>CACTCGGTCCATTGAGGTCTGGGCTCCAGCCTTTGTGTGGGGTGAATTGAGCTGAGC<br>GGCTAGCTGGTTGGAGGAAAGGAAAGAGCTTGCTTTCAACCTCAAAAGCTAGGAGGAA<br>AGGGCTCTGAAATTTGCTCAGAATTCCCAATTCACCATTAGCCTGTTTCTTCCTTTAGC<br>CTCAAGGCATTCTCCGCTTTTTGAAAAGATGTTAAGAAATTCAGTCACAATAGAGAGCC<br>TAGTTTTGAACATGTTTCACTCGGTCCATTGAGGTCTGGGCTCCAGCCTTTGTGTGGG<br>GTGAATTGAGCTGAGCGGCTAGCTGGTTGGAGGAAAGGAAAGAGCTTGCTTTCAACCT<br>CAAAAGCTAGGAGGAAAGGGCTCTGAAATTTGCTCAGAATTCCCAATTCACCATTAGC<br>CTGTTTCTTCCTTTAGCCTCAAGGCATTCTCCGCTTTTTGAAAAGATGTTAAGAAATTCA<br>GTCACAATAGAGAGCCTAGTTTTGAACATGTTTCACTCGGTCCATTGAGGTCTGGGCTC<br>CAGCCTTTGTGTGGGGTGAATTGAGCTGAGCGGCTAGCTGGTTGGAG (SEQ ID NO:<br>371) |
| 3xCore_eHGT_373m (955)<br>GTTTGGGGTAAGGGATGGAAGTGGAAAAAAAAAAAAAAAAAAAGGAAAGAAAAAGCAAAC<br>AAAAGCCAACCAGCCTTCCAGCTGCTGAAGGAGCTGGGGCACAACCCTTGAAGAGTG<br>CCCCTGCCGGGAACAGAGAGGACTCCAGCTGCCTGCCCACTGGGCCAGAGCGCTGC<br>CTTAAAAGAACTTTTGCATAAAAGGAAAAGAGGCCAAGGCTCCCCTTTTGCTGCAGGA<br>CACAGGGCCAGTGTCCACAAGAGTTGAGTGTCCTGGCCAAAGCCAAAGCTAGGGATC<br>ATTGAAAATGCCTGGGCAGCTGGCATGGCTGATGTTTGGGGTAAGGGATGGAAGTGG<br>AAAAAAAAAAAAAAAAAAAGGAAAGAAAAAGCAAACAAAAGCCAACCAGCCTTCCAGCTG<br>CTGAAGGAGCTGGGGCACAACCCTTGAAGAGTGCCCCTGCCGGGAACAGAGAGGACT<br>CCAGCTGCCTGCCCACTGGGCCAGAGCGCTGCCTTAAAAGAACTTTTGCATAAAAGGA<br>AAAGAGGCCAAGGCTCCCCTTTTGCTGCAGGACACAGGGCCAGTGTCCACAAGAGTT<br>GAGTGTCCTGGCCAAAGCCAAAGCTAGGGATCATTGAAAATGCCTGGGCAGCTGGCA<br>TGGCTGATGTTTGGGGTAAGGGATGGAAGTGGAAAAAAAAAAAAAAAAAAAGGAAAGAAA<br>AAGCAAACAAAAGCCAACCAGCCTTCCAGCTGCTGAAGGAGCTGGGGCACAACCCTT<br>GAAGAGTGCCCCTGCCGGGAACAGAGAGGACTCCAGCTGCCTGCCCACTGGGCCAG<br>AGCGCTGCCTTAAAAGAACTTTTGCATAAAAGGAAAAGAGGCCAAGGCTCCCCTTTTG<br>CTGCAGGACACAGGGCCAGTGTCCACAAGAGTTGAGTGTCCTGGCCAAAGCCAAAGC<br>TAGGGATCATTGAAAATGCCTGGGCAGCTGGCATGGCTG (SEQ ID NO: 372) |

FIG. 26

| Vector ID (length between ITRs) & Sequence Between ITRs |
| --- |
| CN2084 (1699)<br>GCGGCCGCACGCGTCATTCCTTCAGAGAAATGTTTGGGGTAAGGGATGGAAGTGGAAAAAAA<br>AAAAAAAAAAAAGGAAAGAAAAAGCAAACAAAAGCCAACCAGCCTTCCAGCTGCTGAAGGAGC<br>TGGGGCACAACCCTTGAAGAGTGCCCCTGCCGGGAACAGAGAGGACTCCAGCTGCCTGCCC<br>ACTGGGCCAGAGCGCTGCCTTAAAAGAACTTTTGCATAAAAGGAAAAGAGGCCAAGGCTCCC<br>CTTTTGCTGCAGGACACAGGGCCAGTGTCCACAAGAGTTGAGTGTCCTGGCCAAAGCCAAAG<br>CTAGGGATCATTGAAAATGCCTGGGCAGCTGGCATGGCTGATCAGTGAGCTCGGGCTGGGC<br>ATAAAAGTCAGGGCAGAGCCATCTATTGCTTACATTTGCTTCTGGGATCCAGATCTTTCGAAG<br>CTAGCGCTACCGGTCGCCACCATGGTGAGCAAGGGCGAGGAGCTGTTCACCGGGGTGGTG<br>CCCATCCTGGTCGAGCTGGACGGCGACGTAAACGGCCACAAGTTCAGCGTGTCCGGCGAGG<br>GCGAGGGCGATGCCACCTACGGCAAGCTGACCCTGAAGCTGATCTGCACCACCGGCAAGCT<br>GCCCGTGCCCTGGCCCACCCTCGTGACCACCCTGGGCTACGGCGTGCAGTGCTTCGCCCG<br>CTACCCCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAGGACGG<br>CAACATCCTGGGGCACAAGCTGGAGTACAACTACAACAGCCACAACGTCTATATCACCGCCG<br>ACAAGCAGAAGAACGGCATCAAGGCCAACTTCAAGATCCGCCACAACATCGAGGACGGCGG<br>CGTGCAGCTCGCCGACCACTACCAGCAGAACACCCCCATCGGCGACGGCCCCGTGCTGCTG<br>CCCGACAACCACTACCTGAGCTACCAGTCCAAGCTGAGCAAAGACCCCAACGAGAAGCGCG<br>ATCACATGGTCCTGCTGGAGTTCGTGACCGCCGCCGGGATCACTCTCGGCATGGACGAGCT<br>GTACAAGTAAGTCGACGGCGCGCCGCGGCCGCGAATTCGATATCATAATCAACCTCTGGATT<br>ACAAAATTTGTGAAAGATTGACTGGTATTCTTAACTATGTTGCTCCTTTTACGCTATGTGGATA<br>CGCTGCTTTAATGCCTTTGTATCATGCTATTGCTTCCCGTATGGCTTTCATTTTCTCCTCCTTG<br>TATAAATCCTGGTTAGTTCTTGCCACGGCGGAACTCATCGCCGCCTGCCTTGCCCGCTGCTG<br>GACAGGGGCTCGGCTGTTGGGCACTGACAATTCCGTGGCTCGAGAGATCTTCGACTGTGCC<br>TTCTAGTTGCCAGCCATCTGTTGTTTGCCCCTCCCCCGTGCCTTCCTTGACCCTGGAAGGTG<br>CCACTCCCACTGTCCTTTCCTAATAAAATGAGGAAATTGCATCGCATTGTCTGAGTAGGTGTC<br>ATTCTATTCTGGGGGGTGGGGTGGGGCAGGACAGCAAGGGGGAGGATTGGGAAGACAATA<br>GCAGGCATGAGATCTCACGTGCGGACCGAGCGGCCGC (SEQ ID NO: 171) |

| Fig 26 cont'd |
| --- |
| Vector ID (length between ITRs) & Sequence Between ITRs |
| CN2085 (1680)<br>GCGGCCGCACGCGTTGCAGAGGGAAGATGAAGTCTTTGATGATAGCCAACTTAGTGTCAATA<br>AGTGGCTTTCTTTGAGACATATTCAGATGGGAACGTCTTGCTTGCCAATTGCCATAGAAATCT<br>TAACACACCATGAAGATTGTCCAAGCGCCAAGCCTTCCGTTCTGGACTAAATTACTTTGAAGT<br>GGCTCAGGACGAGCAGTGGTCAATTTTAACTCTATAGACTGGACAGAAGAGGCTGGGAGTG<br>GGAGATTGTGCGTTTTAAAGCAGAAAATAAGAAGGGGAAACTTGTTTTATACACTCTATACAA<br>GCTTCTGCTCATTGTCAGATATCTGAGCTCGGGCTGGGCATAAAAGTCAGGGCAGAGCCATC<br>TATTGCTTACATTTGCTTCTGGGATCCAGATCTTTCGAAGCTAGCGCTACCGGTCGCCACCAT<br>GGTGAGCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACCTACGG<br>CAAGCTGACCCTGAAGCTGATCTGCACCACCGGCAAGCTGCCCGTGCCCTGGCCCACCCTC<br>GTGACCACCCTGGGCTACGGCGTGCAGTGCTTCGCCCGCTACCCCGACCACATGAAGCAGC<br>ACGACTTCTTCAAGTCCGCCATGCCCGAAGGCTACGTCCAGGAGCGCACCATCTTCTTCAAG<br>GACGACGGCAACTACAAGACCCGCGCCGAGGTGAAGTTCGAGGGCGACACCCTGGTGAAC<br>CGCATCGAGCTGAAGGGCATCGACTTCAAGGAGGACGGCAACATCCTGGGGCACAAGCTGG<br>AGTACAACTACAACAGCCACAACGTCTATATCACCGCCGACAAGCAGAAGAACGGCATCAAG<br>GCCAACTTCAAGATCCGCCACAACATCGAGGACGGCGGCGTGCAGCTCGCCGACCACTACC<br>AGCAGAACACCCCCATCGGCGACGGCCCCGTGCTGCTGCCCGACAACCACTACCTGAGCTA<br>CCAGTCCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAGTAAGTCGACGGCGCG<br>CCGCGGCCGCGAATTCGATATCATAATCAACCTCTGGATTACAAAATTTGTGAAAGATTGACT<br>GGTATTCTTAACTATGTTGCTCCTTTTACGCTATGTGGATACGCTGCTTTAATGCCTTTGTATC<br>ATGCTATTGCTTCCCGTATGGCTTTCATTTTCTCCTCCTTGTATAAATCCTGGTTAGTTCTTGC<br>CACGGCGGAACTCATCGCCGCCTGCCTTGCCCGCTGCTGGACAGGGGCTCGGCTGTTGGG<br>CACTGACAATTCCGTGGCTCGAGAGATCTTCGACTGTGCCTTCTAGTTGCCAGCCATCTGTT<br>GTTTGCCCCTCCCCCGTGCCTTCCTTGACCCTGGAAGGTGCCACTCCCACTGTCCTTTCCTA<br>ATAAAATGAGGAAATTGCATCGCATTGTCTGAGTAGGTGTCATTCTATTCTGGGGGGTGGGG<br>TGGGGCAGGACAGCAAGGGGGAGGATTGGGAAGACAATAGCAGGCATGAGATCTCACGTG<br>CGGACCGAGCGGCCGC (SEQ ID NO: 172) |
| CN2086 (1915)<br>GCGGCCGCACGCGTACCTTGATGACGTTGCTCTTCCAATACTGGAATTAAAATGACCAGCTT<br>CGGAGCAGTAAATACAACAATGGAGATCACACAGTTCCAACCCTAAAGCACCCACTCACCAT<br>CCTGCTTTGTCAAGAACTGAGCTGTTTCTAGGGTACAGGGCTTGTGTTTTTCAAACAGTAGTT<br>GTGACCACATTCAGGGCAAGTTGAACAACCCTGAGCCAGAATTCTATGGCAACTGGCAGCCC<br>TTCCCCATCAGCCTGAAGAGGTCTATTCTCTAAGCATAAAGCACACATGACAGGGCTGGTCA<br>CCTTCCAGTTTTTCAAGCCTTCTCCTTGCTGACCTGGCCAACAAGAATACTTGTTGGCTGTGA<br>ACGGTCAGAACATACACAATTAAGTACAAGTGAAGGTGGGGACCATGTATATTTGACAAAAG<br>GGTCTTCAGAGAACTCTTTGATGTCTACATCAGGGGTTTCTAACCTGAGATAGAGGGTGAGG<br>GGCATCCATGAATTTGAAGGGGAAGATTGCATCTATCATGACTTATACCCATATTTACCCCAA<br>ATACACTTCCGAGCTCGGGCTGGGCATAAAAGTCAGGGCAGAGCCATCTATTGCTTACATTT<br>GCTTCTGGGATCCAGATCTTTCGAAGCTAGCGCTACCGGTCGCCACCATGGTGAGCAAGGG<br>CGAGGAGCTGTTCACCGGGGTGGTGCCCATCCTGGTCGAGCTGGACGGCGACGTAAACGG<br>CCACAAGTTCAGCGTGTCCGGCGAGGGCGAGGGCGATGCCACCTACGGCAAGCTGACCCT<br>GAAGCTGATCTGCACCACCGGCAAGCTGCCCGTGCCCTGGCCCACCCTCGTGACCACCCTG<br>GGCTACGGCGTGCAGTGCTTCGCCCGCTACCCCGACCACATGAAGCAGCACGACTTCTTCA<br>AGTCCGCCATGCCCGAAGGCTACGTCCAGGAGCGCACCATCTTCTTCAAGGACGACGGCAA<br>CTACAAGACCCGCGCCGAGGTGAAGTTCGAGGGCGACACCCTGGTGAACCGCATCGAGCTG<br>AAGGGCATCGACTTCAAGGAGGACGGCAACATCCTGGGGCACAAGCTGGAGTACAACTACA<br>ACAGCCACAACGTCTATATCACCGCCGACAAGCAGAAGAACGGCATCAAGGCCAACTTCAAG |

| Fig 26 cont'd |
|---|
| Vector ID (length between ITRs) & Sequence Between ITRs |
| ATCCGCCACAACATCGAGGACGGCGGCGTGCAGCTCGCCGACCACTACCAGCAGAACACCC CCATCGGCGACGGCCCCGTGCTGCTGCCCGACAACCACTACCTGAGCTACCAGTCCAAGCT GAGCAAAGACCCCAACGAGAAGCGCGATCACATGGTCCTGCTGGAGTTCGTGACCGCCGCC GGGATCACTCTCGGCATGGACGAGCTGTACAAGTAAGTCGACGGCGCGCCGCGGCCGCGA ATTCGATATCATAATCAACCTCTGGATTACAAAATTTGTGAAAGATTGACTGGTATTCTTAACT ATGTTGCTCCTTTTACGCTATGTGGATACGCTGCTTTAATGCCTTTGTATCATGCTATTGCTTC CCGTATGGCTTTCATTTTCTCCTCCTTGTATAAATCCTGGTTAGTTCTTGCCACGGCGGAACT CATCGCCGCCTGCCTTGCCCGCTGCTGGACAGGGGCTCGGCTGTTGGGCACTGACAATTCC GTGGCTCGAGAGATCTTCGACTGTGCCTTCTAGTTGCCAGCCATCTGTTGTTTGCCCCTCCC CCGTGCCTTCCTTGACCCTGGAAGGTGCCACTCCCACTGTCCTTTCCTAATAAAATGAGGAA ATTGCATCGCATTGTCTGAGTAGGTGTCATTCTATTCTGGGGGGTGGGGTGGGGCAGGACA GCAAGGGGGAGGATTGGGAAGACAATAGCAGGCATGAGATCTCACGTGCGGACCGAGCGG CCGC (SEQ ID NO: 173) |
| CN2083 (1574) GCGGCCGCACGCGTTCGTTTGCTTCCTAACGTGCCAGGACTCTGCTGGTTCCACATATAAAA ACACCCCCTGGAGATTTCTTCTTATTTTACATAGCCCTGCCGAGTGGACTGGCCATTCTATGA AAATTGGATGAAATGACACTAAGTCTTGTTGCAGATCCATGAATAAAAGGGGATACCTTTCTC CCTGATGAATAAAGCCCAGCATAGGGTATGCCACAGTGCCTTGAGCTCGGGCTGGGCATAAA AGTCAGGGCAGAGCCATCTATTGCTTACATTTGCTTCTGGGATCCAGATCTTTCGAAGCTAGC GCTACCGGTCGCCACCATGGTGAGCAAGGGCGAGGAGCTGTTCACCGGGGTGGTGCCCAT CCTGGTCGAGCTGGACGGCGACGTAAACGGCCACAAGTTCAGCGTGTCCGGCGAGGGCGA GGGCGATGCCACCTACGGCAAGCTGACCCTGAAGCTGATCTGCACCACCGGCAAGCTGCCC GTGCCCTGGCCCACCCTCGTGACCACCCTGGGCTACGGCGTGCAGTGCTTCGCCCGCTACC CCGACCACATGAAGCAGCACGACTTCTTCAAGTCCGCCATGCCCGAAGGCTACGTCCAGGA GCGCACCATCTTCTTCAAGGACGACGGCAACTACAAGACCCGCGCCGAGGTGAAGTTCGAG GGCGACACCCTGGTGAACCGCATCGAGCTGAAGGGCATCGACTTCAAGGAGGACGGCAACA TCCTGGGGCACAAGCTGGAGTACAACTACAACAGCCACAACGTCTATATCACCGCCGACAAG CAGAAGAACGGCATCAAGGCCAACTTCAAGATCCGCCACAACATCGAGGACGGCGGCGTGC AGCTCGCCGACCACTACCAGCAGAACACCCCCATCGGCGACGGCCCCGTGCTGCTGCCCG ACAACCACTACCTGAGCTACCAGTCCAAGCTGAGCAAAGACCCCAACGAGAAGCGCGATCA CATGGTCCTGCTGGAGTTCGTGACCGCCGCCGGGATCACTCTCGGCATGGACGAGCTGTAC AAGTAAGTCGACGGCGCGCCGCGGCCGCGAATTCGATATCATAATCAACCTCTGGATTACAA AATTTGTGAAAGATTGACTGGTATTCTTAACTATGTTGCTCCTTTTACGCTATGTGGATACGCT GCTTTAATGCCTTTGTATCATGCTATTGCTTCCCGTATGGCTTTCATTTTCTCCTCCTTGTATA AATCCTGGTTAGTTCTTGCCACGGCGGAACTCATCGCCGCCTGCCTTGCCCGCTGCTGGACA GGGGCTCGGCTGTTGGGCACTGACAATTCCGTGGCTCGAGAGATCTTCGACTGTGCCTTCTA GTTGCCAGCCATCTGTTGTTTGCCCCTCCCCCGTGCCTTCCTTGACCCTGGAAGGTGCCACT CCCACTGTCCTTTCCTAATAAAATGAGGAAATTGCATCGCATTGTCTGAGTAGGTGTCATTCT ATTCTGGGGGGTGGGGTGGGGCAGGACAGCAAGGGGGAGGATTGGGAAGACAATAGCAGG CATGAGATCTCACGTGCGGACCGAGCGGCCGC (SEQ ID NO: 174) |
| CN2087 (1786) GCGGCCGCACGCGTAGAGCCTAACCAGGTCCACCTGGAAAATGCGACTAGGCTCAGCACAA GCTGTGCTGCACTGTTTGACCTGGCAGGCCTTCAATTTTGGGGGGCTGAATTGAGTCTGCTT TTGTTTCTCAGGGAGCCTGGAAGAAAGAGGACTTGTTACAGAGGAGGAGGGGAGACAAGGA AGGAACGAGTTAAGCCCTAGGCAGCATCAGCATCTTTAGTTCTTTTTCTTTTTCTCTCTTTTCA AATGAGTACACCACATTGAATAGCGTGTGGAAAATTGGTCTTTCCATTGAATGAAAACGAACT GGCAAGCAACAAAACGGATAAAGGAGGGATGCCGCTGGATGTCATTTGGTTTCGCGCTTGGT TTGTCAGAGGAGGAACCCAGGAGGATCCAATGTTTTAAGATGCATTTTACCTAAAGCTCTGGC CCTGCTGAGCTCGGGCTGGGCATAAAAGTCAGGGCAGAGCCATCTATTGCTTACATTTGCTT |

| Fig 26 cont'd |
| --- |
| Vector ID (length between ITRs) & Sequence Between ITRs |
| CTGGGATCCAGATCTTTCGAAGCTAGCGCTACCGGTCGCCACCATGGTGAGCAAGGGCGAG<br>GAGCTGTTCACCGGGGTGGTGCCCATCCTGGTCGAGCTGGACGGCGACGTAAACGGCCAC<br>AAGTTCAGCGTGTCCGGCGAGGGCGAGGGCGATGCCACCTACGGCAAGCTGACCCTGAAG<br>CTGATCTGCACCACCGGCAAGCTGCCCGTGCCCTGGCCCACCCTCGTGACCACCCTGGGCT<br>ACGGCGTGCAGTGCTTCGCCCGCTACCCCGACCACATGAAGCAGCACGACTTCTTCAAGTC<br>CGCCATGCCCGAAGGCTACGTCCAGGAGCGCACCATCTTCTTCAAGGACGACGGCAACTAC<br>AAGACCCGCGCCGAGGTGAAGTTCGAGGGCGACACCCTGGTGAACCGCATCGAGCTGAAG<br>GGCATCGACTTCAAGGAGGACGGCAACATCCTGGGGCACAAGCTGGAGTACAACTACAACA<br>GCCACAACGTCTATATCACCGCCGACAAGCAGAAGAACGGCATCAAGGCCAACTTCAAGATC<br>CGCCACAACATCGAGGACGGCGGCGTGCAGCTCGCCGACCACTACCAGCAGAACACCCCC<br>ATCGGCGACGGCCCCGTGCTGCTGCCCGACAACCACTACCTGAGCTACCAGTCCAAGCTGA<br>GCAAAGACCCCAACGAGAAGCGCGATCACATGGTCCTGCTGGAGTTCGTGACCGCCGCCGG<br>GATCACTCTCGGCATGGACGAGCTGTACAAGTAAGTCGACGGCGCGCCGCGGCCGCGAATT<br>CGATATCATAATCAACCTCTGGATTACAAAATTTGTGAAAGATTGACTGGTATTCTTAACTATG<br>TTGCTCCTTTTACGCTATGTGGATACGCTGCTTTAATGCCTTTGTATCATGCTATTGCTTCCCG<br>TATGGCTTTCATTTTCTCCTCCTTGTATAAATCCTGGTTAGTTCTTGCCACGGCGGAACTCATC<br>GCCGCCTGCCTTGCCCGCTGCTGGACAGGGGCTCGGCTGTTGGGCACTGACAATTCCGTGG<br>CTCGAGAGATCTTCGACTGTGCCTTCTAGTTGCCAGCCATCTGTTGTTTGCCCCTCCCCCGT<br>GCCTTCCTTGACCCTGGAAGGTGCCACTCCCACTGTCCTTTCCTAATAAAATGAGGAAATTGC<br>ATCGCATTGTCTGAGTAGGTGTCATTCTATTCTGGGGGGTGGGGTGGGGCAGGACAGCAAG<br>GGGGAGGATTGGGAAGACAATAGCAGGCATGAGATCTCACGTGCGGACCGAGCGGCCGC<br>(SEQ ID NO: 175) |
| CN2088 (1686)<br>GCGGCCGCACGCGTACAGGGCTGGGGATCAAAGGGGGCCAGCACCATGTCTAGAGGGCAG<br>AGATCCTGCCACTGGCTGGTGGCCCCTGGTTGTCTTGGAACTCCACCTGCTGTTCATCAGCA<br>GGGCTATGGGAATCTGGACACACCTCCTCTGGCTCAGACCAATCCCAGCTGCTGCTGGCCA<br>GGGCGGGCCTGGGCCATGGGATCTGGAGGAAAGGTCACTTGTGACTGGAAGGACAGTGGG<br>CAGGAAGAAAGAGCCAAGCTAGAGTAGGGGAGGGCACCCCTCCTTGTCCTCTAGACTTCCT<br>GTTCCATCTCCTGTCCCTGTAGGGCTCCAGCTAAAAGCGAGCTCGGGCTGGGCATAAAAGTC<br>AGGGCAGAGCCATCTATTGCTTACATTTGCTTCTGGGATCCAGATCTTTCGAAGCTAGCGCTA<br>CCGGTCGCCACCATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCGAGGGC<br>GATGCCACCTACGGCAAGCTGACCCTGAAGCTGATCTGCACCACCGGCAAGCTGCCCGTGC<br>CCTGGCCCACCCTCGTGACCACCCTGGGCTACGGCGTGCAGTGCTTCGCCCGCTACCCCGA<br>CCACATGAAGCAGCACGACTTCTTCAAGTCCGCCATGCCCGAAGGCTACGTCCAGGAGCGC<br>ACCATCTTCTTCAAGGACGACGGCAACTACAAGACCCGCGCCGAGGTGAAGTTCGAGGGCG<br>ACACCCTGGTGAACCGCATCGAGCTGAAGGGCATCGACTTCAAGGAGGACGGCAACATCCT<br>GGGGCACAAGCTGGAGTACAACTACAACAGCCACAACGTCTATATCACCGCCGACAAGCAG<br>AAGAACGGCATCAAGGCCAACTTCAAGATCCGCCACAACATCGAGGACGGCGGCGTGCAGC<br>TCGCCGACCACTACCAGCAGAACACCCCCATCGGCGACGGCCCCGTGCTGCTGCCCGACAA<br>CCACTACCTGAGCTACCAGTCCAAGCTGAGCAAAGACCCCAACGAGAAGCGCGATCACATG<br>GTCCTGCTGGAGTTCGTGACCGCCGCCGGGATCACTCTCGGCATGGACGAGCTGTACAAGT<br>AAGTCGACGGCGCGCCGCGGCCGCGAATTCGATATCATAATCAACCTCTGGATTACAAAATT<br>TGTGAAAGATTGACTGGTATTCTTAACTATGTTGCTCCTTTTACGCTATGTGGATACGCTGCTT<br>TAATGCCTTTGTATCATGCTATTGCTTCCCGTATGGCTTTCATTTTCTCCTCCTTGTATAAATC<br>CTGGTTAGTTCTTGCCACGGCGGAACTCATCGCCGCCTGCCTTGCCCGCTGCTGGACAGGG<br>GCTCGGCTGTTGGGCACTGACAATTCCGTGGCTCGAGAGATCTTCGACTGTGCCTTCTAGTT<br>GCCAGCCATCTGTTGTTTGCCCCTCCCCCGTGCCTTCCTTGACCCTGGAAGGTGCCACTCCC<br>ACTGTCCTTTCCTAATAAAATGAGGAAATTGCATCGCATTGTCTGAGTAGGTGTCATTCTATTC |

| Fig 26 cont'd |
|---|
| Vector ID (length between ITRs) & Sequence Between ITRs |
| TGGGGGGTGGGGTGGGGCAGGACAGCAAGGGGGAGGATTGGGAAGACAATAGCAGGCATG<br>AGATCTCACGTGCGGACCGAGCGGCCGC (SEQ ID NO: 176) |
| CN2089 (2054)<br>GCGGCCGCACGCGTTCCAGACCTTGAACATAAAAGGCATTTTATACCCGCAATTGTTCATTTA<br>ATGAGCAATTGCGGAGTGCAGGCCGGTTAAGGGATTGAGCTATATGCACTATTATTGCAAGA<br>AGTATTCCGAAATACCAGAAATAGGACGTAAGCTCTGATCAGGGAGACTGCGAGCACAATTA<br>CCTTCTTTTCAAATCCTTCTGTGACACTGCGGGAGGAAAAAGGACTTTGAAACTTGAAAGGAA<br>AGAGCTTGCTTTCAACCTCAAAAGCTAGGAGGAAAGGGCTCTGAAATTTGCTCAGAATTCCCA<br>ATTCACCATTAGCCTGTTTCTTCCTTTAGCCTCAAGGCATTCTCCGCTTTTTGAAAAGATGTTA<br>AGAAATTCAGTCACAATAGAGAGCCTAGTTTTGAACATGTTTCACTCGGTCCATTGAGGTCTG<br>GGCTCCAGCCTTTGTGTGGGGTGAATTGAGCTGAGCGGCTAGCTGGTTGGAGAGAGGTGAA<br>TGAGAAGTCGCTGTGCAGTTGCAAATTCTGGCAAAGAAAAAAAAAAAGCTCACCCCTTCCTTT<br>ATTTTGTAATATGCATTCCTGTACAATCCTGCCAGTGGCAATCTGTGGAGTTCAGTGTGTCCC<br>TAAGTCAATATGGAGTACTTGGTTTATAGCAACTCTTGTTAAGTTTGTCTTGTAATTGAAGCTG<br>CTGTTGACCTTGCTTGGGGGAGCTCGGGCTGGGCATAAAAGTCAGGGCAGAGCCATCTATT<br>GCTTACATTTGCTTCTGGGATCCAGATCTTTCGAAGCTAGCGCTACCGGTCGCCACCATGGT<br>GAGCAAGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTACGGCAA<br>GCTGACCCTGAAGCTGATCTGCACCACCGGCAAGCTGCCCGTGCCCTGGCCCACCCTCGTG<br>ACCACCCTGGGCTACGGCGTGCAGTGCTTCGCCCGCTACCCCGACCACATGAAGCAGCACG<br>ACTTCTTCAAGTCCGCCATGCCCGAAGGCTACGTCCAGGAGCGCACCATCTTCTTCAAGGAC<br>GACGGCAACTACAAGACCCGCGCCGAGGTGAAGTTCGAGGGCGACACCCTGGTGAACCGC<br>ATCGAGCTGAAGGGCATCGACTTCAAGGAGGACGGCAACATCCTGGGGCACAAGCTGGAGT<br>ACAACTACAACAGCCACAACGTCTATATCACCGCCGACAAGCAGAAGAACGGCATCAAGGCC<br>AACTTCAAGATCCGCCACAACATCGAGGACGGCGGCGTGCAGCTCGCCGACCACTACCAGC<br>AGAACACCCCCATCGGCGACGGCCCCGTGCTGCTGCCCGACAACCACTACCTGAGCTACCA<br>GTCCAAGCTGAGCAAAGACCCCAACGAGAAGCGCGATCACATGGTCCTGCTGGAGTTCGTG<br>ACCGCCGCCGGGATCACTCTCGGCATGGACGAGCTGTACAAGTAAGTCGACGGCGCGCCG<br>CGGCCGCGAATTCGATATCATAATCAACCTCTGGATTACAAAATTTGTGAAAGATTGACTGGT<br>ATTCTTAACTATGTTGCTCCTTTTACGCTATGTGGATACGCTGCTTTAATGCCTTTGTATCATG<br>CTATTGCTTCCCGTATGGCTTTCATTTTCTCCTCCTTGTATAAATCCTGGTTAGTTCTTGCCAC<br>GGCGGAACTCATCGCCGCCTGCCTTGCCCGCTGCTGGACAGGGGCTCGGCTGTTGGGCAC<br>TGACAATTCCGTGGCTCGAGAGATCTTCGACTGTGCCTTCTAGTTGCCAGCCATCTGTTGTTT<br>GCCCCTCCCCCGTGCCTTCCTTGACCCTGGAAGGTGCCACTCCCACTGTCCTTTCCTAATAA<br>AATGAGGAAATTGCATCGCATTGTCTGAGTAGGTGTCATTCTATTCTGGGGGGTGGGGTGGG<br>GCAGGACAGCAAGGGGGAGGATTGGGAAGACAATAGCAGGCATGAGATCTCACGTGCGGA<br>CCGAGCGGCCGC (SEQ ID NO: 177) |
| CN2082 (1671)<br>GCGGCCGCACGCGTATTCAGGACCAGGGCCACAGCTGCTGCCTCTTTCCCCTCCAGCCATG<br>GTCTGAGCTCTGAGAATTCTAGATGGGCCATGGCAGTGAGCTTGGGAAAGATTGCCAGGAA<br>GACGCTGAGACCTGGCTCCCAGGAGAGAGGTGTGAGGCACTGGCTGGAAGCCCAGTGCCT<br>GGCTGCCCTGGTTTCCTGGGGCCCAGACATGCGTGATTAGTCCACAGCAAAAGCCTGGCCA<br>GAAGTCAGAGGGGGAGGGGAAGGCAGGGGGAGGATGCTCTGAGTTTGGCAGGGAGAGACC<br>AAAACAGAGTGGGGCTGGGATGAGGAGCTCGGGCTGGGCATAAAAGTCAGGGCAGAGCCA<br>TCTATTGCTTACATTTGCTTCTGGGATCCAGATCTTTCGAAGCTAGCGCTACCGGTCGCCACC<br>ATGGTGAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCACCTAC<br>GGCAAGCTGACCCTGAAGCTGATCTGCACCACCGGCAAGCTGCCCGTGCCCTGGCCCACCC<br>TCGTGACCACCCTGGGCTACGGCGTGCAGTGCTTCGCCCGCTACCCCGACCACATGAAGCA |

| Fig 26 cont'd |
|---|
| Vector ID (length between ITRs) & Sequence Between ITRs |

GCACGACTTCTTCAAGTCCGCCATGCCCGAAGGCTACGTCCAGGAGCGCACCATCTTCTTCA
AGGACGACGGCAACTACAAGACCCGCGCCGAGGTGAAGTTCGAGGGCGACACCCTGGTGA
ACCGCATCGAGCTGAAGGGCATCGACTTCAAGGAGGACGGCAACATCCTGGGGCACAAGCT
GGAGTACAACTACAACAGCCACAACGTCTATATCACCGCCGACAAGCAGAAGAACGGCATCA
AGGCCAACTTCAAGATCCGCCACAACATCGAGGACGGCGGCGTGCAGCTCGCCGACCACTA
CCAGCAGAACACCCCCATCGGCGACGGCCCCGTGCTGCTGCCCGACAACCACTACCTGAGC
TACCAGTCCAAGCTGAGCAAAGACCCCAACGAGAAGCGCGATCACATGGTCCTGCTGGAGT
TCGTGACCGCCGCCGGGATCACTCTCGGCATGGACGAGCTGTACAAGTAAGTCGACGGCGC
GCCGCGGCCGCGAATTCGATATCATAATCAACCTCTGGATTACAAAATTTGTGAAAGATTGAC
TGGTATTCTTAACTATGTTGCTCCTTTTACGCTATGTGGATACGCTGCTTTAATGCCTTTGTAT
CATGCTATTGCTTCCCGTATGGCTTTCATTTTCTCCTCCTTGTATAAATCCTGGTTAGTTCTTG
CCACGGCGGAACTCATCGCCGCCTGCCTTGCCCGCTGCTGGACAGGGGCTCGGCTGTTGG
GCACTGACAATTCCGTGGCTCGAGAGATCTTCGACTGTGCCTTCTAGTTGCCAGCCATCTGT
TGTTTGCCCCTCCCCCGTGCCTTCCTTGACCCTGGAAGGTGCCACTCCCACTGTCCTTTCCT
AATAAAATGAGGAAATTGCATCGCATTGTCTGAGTAGGTGTCATTCTATTCTGGGGGGTGGG
GTGGGGCAGGACAGCAAGGGGGAGGATTGGGAAGACAATAGCAGGCATGAGATCTCACGT
GCGGACCGAGCGGCCGC (SEQ ID NO: 178)

CN2090 (1878)
GCGGCCGCACGCGTAGGTTTGCCCTACCTGTGGGAACCCAGCTGAAGAGGGTCTGTCCATA
GGTTGGGTAGATTTGCCCTGGACAAGAACGAAGAATGAACTTAAAACCCCCAAACCTAGAGT
TGGTTTCTAAGCTACTTAGCCAATAAGCTCTTCGTGTGTGGGACTGCTGTGACTACTGCTCTG
TGCCTAGCTCCACCACCAACAAATATTTCCATGAACAAGGCCCATCTCTGTCTGGGGACAAG
CATGTCTTTGTGATCTGCCAACCTCCTGACCACCCACAGCAGGCCATTCAAACACAGGGCTT
CCTATACCACTCAGAAGAGGCTTTCCCGTCTTTCTTAGAAAAAGATATAAAATAGTTGACTTCT
CAAGGTAATTGGAGGAATGACAGAGAAGCTGAGATGTCCCTTCTACCTGGGTGACCCAGCAC
AAGATGCACACTTAACCTGGGGACAGTGATGCTTAGCCAAAGTGGCTAAATCTCTGTGCAAA
TCCCATGAAGGGACCCTGGACATGGGTGAATGCCGAGAGCTCGGGCTGGGCATAAAAGTCA
GGGCAGAGCCATCTATTGCTTACATTTGCTTCTGGGATCCAGATCTTTCGAAGCTAGCGCTAC
CGGTCGCCACCATGGTGAGCAAGGGCGAGGAGCTGTTCACCGGGGTGGTGCCCATCCTGG
TCGAGCTGGACGGCGACGTAAACGGCCACAAGTTCAGCGTGTCCGGCGAGGGCGAGGGCG
ATGCCACCTACGGCAAGCTGACCCTGAAGCTGATCTGCACCACCGGCAAGCTGCCCGTGCC
CTGGCCCACCCTCGTGACCACCCTGGGCTACGGCGTGCAGTGCTTCGCCCGCTACCCCGAC
CACATGAAGCAGCACGACTTCTTCAAGTCCGCCATGCCCGAAGGCTACGTCCAGGAGCGCA
CCATCTTCTTCAAGGACGACGGCAACTACAAGACCCGCGCCGAGGTGAAGTTCGAGGGCGA
CACCCTGGTGAACCGCATCGAGCTGAAGGGCATCGACTTCAAGGAGGACGGCAACATCCTG
GGGCACAAGCTGGAGTACAACTACAACAGCCACAACGTCTATATCACCGCCGACAAGCAGAA
GAACGGCATCAAGGCCAACTTCAAGATCCGCCACAACATCGAGGACGGCGGCGTGCAGCTC
GCCGACCACTACCAGCAGAACACCCCCATCGGCGACGGCCCCGTGCTGCTGCCCGACAAC
CACTACCTGAGCTACCAGTCCAAGCTGAGCAAAGACCCCAACGAGAAGCGCGATCACATGG
TCCTGCTGGAGTTCGTGACCGCCGCCGGGATCACTCTCGGCATGGACGAGCTGTACAAGTA
AGTCGACGGCGCGCCGCGGCCGCGAATTCGATATCATAATCAACCTCTGGATTACAAAATTT
GTGAAAGATTGACTGGTATTCTTAACTATGTTGCTCCTTTTACGCTATGTGGATACGCTGCTTT
AATGCCTTTGTATCATGCTATTGCTTCCCGTATGGCTTTCATTTTCTCCTCCTTGTATAAATCC
TGGTTAGTTCTTGCCACGGCGGAACTCATCGCCGCCTGCCTTGCCCGCTGCTGGACAGGGG
CTCGGCTGTTGGGCACTGACAATTCCGTGGCTCGAGAGATCTTCGACTGTGCCTTCTAGTTG
CCAGCCATCTGTTGTTTGCCCCTCCCCCGTGCCTTCCTTGACCCTGGAAGGTGCCACTCCCA
CTGTCCTTTCCTAATAAAATGAGGAAATTGCATCGCATTGTCTGAGTAGGTGTCATTCTATTCT
GGGGGGTGGGGTGGGGCAGGACAGCAAGGGGGAGGATTGGGAAGACAATAGCAGGCATG
AGATCTCACGTGCGGACCGAGCGGCCGC (SEQ ID NO: 179)

| Fig 26 cont'd |
| :--- |
| Vector ID (length between ITRs) & Sequence Between ITRs |
| CN2091 (1860) <br> GCGGCCGCACGCGTTCACAGCCCTCAGTGACTGCTCCTCCACTACACTATCGGGAAACTGA <br> GGCCCAGGGTGGCCACATGACCCTTCCTGGGGTCTCCCCTCACTCGGGGCACAGCTAGGCA <br> GATGAGGGCATGCAGAACTTGGCCTAGCATAGCCTGGCCTAGCTCAACCTCCACCCCCATC <br> CTGGCCCTTCTCCCTACACTGAAAGAGACTTTATGGGGATAAGAAGTCACCCATTGTGTCACA <br> GGAGACAAAGGGGCAAGAGACACAGGCTCCAGGCGCCTGGGCTGGCCATACCACCACCAC <br> ACACCACCCCTCTCTGTGCCAAAGGAGGGCTGGTGAGGCACCTTGGAATTCCTGCACTGGA <br> TATTTTAGAACATGGGGCGGGGGGAGGTACACCATGTCTAGATCTCCAGGAAGCCCAAAGC <br> CACCAAGCTGTCCCTTTCTCTATCTGAAACAGACACACGAGAAACCAGAGTCACTCAAGC <br> CAGCACACTCTCTCCCAGGACCGGTTGAGCTCGGGCTGGGCATAAAAGTCAGGGCAGAGCC <br> ATCTATTGCTTACATTTGCTTCTGGGATCCAGATCTTTCGAAGCTAGCGCTACCGGTCGCCAC <br> CATGGTGAGCAAGGGCGAGGAGCTGTTCACCGGGGTGGTGCCCATCCTGGTCGAGCTGGA <br> CGGCGACGTAAACGGCCACAAGTTCAGCGTGTCCGGCGAGGGCGAGGGCGATGCCACCTA <br> CGGCAAGCTGACCCTGAAGCTGATCTGCACCACCGGCAAGCTGCCCGTGCCCTGGCCCACC <br> CTCGTGACCACCCTGGGCTACGGCGTGCAGTGCTTCGCCCGCTACCCCGACCACATGAAGC <br> AGCACGACTTCTTCAAGTCCGCCATGCCCGAAGGCTACGTCCAGGAGCGCACCATCTTCTTC <br> AAGGACGACGGCAACTACAAGACCCGCGCCGAGGTGAAGTTCGAGGGCGACACCCTGGTG <br> AACCGCATCGAGCTGAAGGGCATCGACTTCAAGGAGGACGGCAACATCCTGGGGCACAAGC <br> TGGAGTACAACTACAACAGCCACAACGTCTATATCACCGCCGACAAGCAGAAGAACGGCATC <br> AAGGCCAACTTCAAGATCCGCCACAACATCGAGGACGGCGGCGTGCAGCTCGCCGACCACT <br> ACCAGCAGAACACCCCCATCGGCGACGGCCCCGTGCTGCTGCCCGACAACCACTACCTGAG <br> CTACCAGTCCAAGCTGAGCAAAGACCCCAACGAGAAGCGCGATCACATGGTCCTGCTGGAG <br> TTCGTGACCGCCGCCGGGATCACTCTCGGCATGGACGAGCTGTACAAGTAAGTCGACGGCG <br> CGCCGCGGCCGCGAATTCGATATCATAATCAACCTCTGGATTACAAAATTTGTGAAAGATTGA <br> CTGGTATTCTTAACTATGTTGCTCCTTTTACGCTATGTGGATACGCTGCTTTAATGCCTTTGTA <br> TCATGCTATTGCTTCCCGTATGGCTTTCATTTTCTCCTCCTTGTATAAATCCTGGTTAGTTCTT <br> GCCACGGCGGAACTCATCGCCGCCTGCCTTGCCCGCTGCTGGACAGGGGCTCGGCTGTTG <br> GGCACTGACAATTCCGTGGCTCGAGAGATCTTCGACTGTGCCTTCTAGTTGCCAGCCATCTG <br> TTGTTTGCCCCTCCCCCGTGCCTTCCTTGACCCTGGAAGGTGCCACTCCCACTGTCCTTTCC <br> TAATAAAATGAGGAAATTGCATCGCATTGTCTGAGTAGGTGTCATTCTATTCTGGGGGGTGGG <br> GTGGGGCAGGACAGCAAGGGGGAGGATTGGGAAGACAATAGCAGGCATGAGATCTCACGT <br> GCGGACCGAGCGGCCGC (SEQ ID NO: 180) |
| CN2092 (1738) <br> GCGGCCGCACGCGTGCTTAGAGAAGGGCCTGGCACACAGTAGGTCCCCCTGCTGGGCTAG <br> ATGCTATTGGTGGTGGCTTTTTGGTGCTTGCCTTCCTCCTGCCCCACCCTGTGCTGTCTGCC <br> ACTGTTTGCACATTGTATGGTTCTTTTCATGAGGAATGTTTCAAAGAGCATGACAGAATCTTAC <br> AACAATCAGCCCATTGTCTGTGTGCTCCAGAGCCGACTCTGAGGTCCTGGGGTGGCCGGAG <br> GCTGTCAGGGAAGGGAATGGGGAGAGAGGAGGCGAGGCTTGGGTGGGCAGTGTTCTGAGG <br> GGATTGATTGCCCTCGGGAGTTGTGGTTCTTGTGTCAGAATCAGGCCTTTTGTTCAGGTCTTT <br> TTATGCACAAGCTATTTGGGACCCGAGCTCGGGCTGGGCATAAAAGTCAGGGCAGAGCCAT <br> CTATTGCTTACATTTGCTTCTGGGATCCAGATCTTTCGAAGCTAGCGCTACCGGTCGCCACCA <br> TGGTGAGCAAGGGCGAGGAGCTGTTCACCGGGGTGGTGCCCATCCTGGTCGAGCTGGACG <br> GCGACGTAAACGGCCACAAGTTCAGCGTGTCCGGCGAGGGCGAGGGCGATGCCACCTACG <br> GCAAGCTGACCCTGAAGCTGATCTGCACCACCGGCAAGCTGCCCGTGCCCTGGCCCACCCT <br> CGTGACCACCCTGGGCTACGGCGTGCAGTGCTTCGCCCGCTACCCCGACCACATGAAGCAG <br> CACGACTTCTTCAAGTCCGCCATGCCCGAAGGCTACGTCCAGGAGCGCACCATCTTCTTCAA <br> GGACGACGGCAACTACAAGACCCGCGCCGAGGTGAAGTTCGAGGGCGACACCCTGGTGAA <br> CCGCATCGAGCTGAAGGGCATCGACTTCAAGGAGGACGGCAACATCCTGGGGCACAAGCTG <br> GAGTACAACTACAACAGCCACAACGTCTATATCACCGCCGACAAGCAGAAGAACGGCATCAA |

| Fig 26 cont'd |
|---|
| Vector ID (length between ITRs) & Sequence Between ITRs |
| GGCCAACTTCAAGATCCGCCACAACATCGAGGACGGCGGCGTGCAGCTCGCCGACCACTAC CAGCAGAACACCCCCATCGGCGACGGCCCCGTGCTGCTGCCCGACAACCACTACCTGAGCT ACCAGTCCAAGCTGAGCAAAGACCCCAACGAGAAGCGCGATCACATGGTCCTGCTGGAGTT CGTGACCGCCGCCGGGATCACTCTCGGCATGGACGAGCTGTACAAGTAAGTCGACGGCGC GCCGCGGCCGCGAATTCGATATCATAATCAACCTCTGGATTACAAAATTTGTGAAAGATTGAC TGGTATTCTTAACTATGTTGCTCCTTTTACGCTATGTGGATACGCTGCTTTAATGCCTTTGTAT CATGCTATTGCTTCCCGTATGGCTTTCATTTTCTCCTCCTTGTATAAATCCTGGTTAGTTCTTG CCACGGCGGAACTCATCGCCGCCTGCCTTGCCCGCTGCTGGACAGGGGCTCGGCTGTTGG GCACTGACAATTCCGTGGCTCGAGAGATCTTCGACTGTGCCTTCTAGTTGCCAGCCATCTGT TGTTTGCCCCTCCCCGTGCCTTCCTTGACCCTGGAAGGTGCCACTCCCACTGTCCTTTCCT AATAAAATGAGGAAATTGCATCGCATTGTCTGAGTAGGTGTCATTCTATTCTGGGGGGTGGG GTGGGGCAGGACAGCAAGGGGGAGGATTGGGAAGACAATAGCAGGCATGAGATCTCACGT GCGGACCGAGCGGCCGC (SEQ ID NO: 181) |
| CN2093 (1847) <br> GCGGCCGCACGCGTTGCCTCTCAACTTCTGGGCTTTAGTTCCTAGCCTTGGACTGGAGAACA AGACTCCCCAAGTCCCAGTCTCAGATCTGCCACTTTTCCTGTTTATAGGATGAAAAACACAGT TTCCCCTGAAGGACAAGGAGACTCAAAACATGGAGCGTCCCAGCCTTCTCCGGGCAGTCCTA GACTCTGTTTGTCTTTACAGCAGTGATCTTAGCTCAGATAAGGTCATGTTTTGTTTTTGTCTTT TGTCTTCCTGCTTGTTCCAGTCGGTCCCAGTCTTTTGAAGTGGGACTGGCTGGGAGGTCACA ATGTCCCTATTGTCTAGGATGACACTTCTGGGCTTAGGTCATGTGTCCAGTGTTCAGAGGAAC CCAGAGCCAAAAGAATCAGACACTAGAACTATCAGTGGCTTAATTGTTCTGCCCTTCTCTCCA GGGCTACTGACAAGGTAAGTGTCTGTGCTTACAGAGGCCTGTGGTGGCAGAATAGCTGAGC CCTGAGCTCGGGCTGGGCATAAAAGTCAGGGCAGAGCCATCTATTGCTTACATTTGCTTCTG GGATCCAGATCTTTCGAAGCTAGCGCTACCGGTCGCCACCATGGTGAGCAAGGGCGAGGAG CTGTTCACCGGGGTGGTGCCCATCCTGGTCGAGCTGGACGGCGACGTAAACGGCCACAAGT TCAGCGTGTCCGGCGAGGGCGAGGGCGATGCCACCTACGGCAAGCTGACCCTGAAGCTGA TCTGCACCACCGGCAAGCTGCCCGTGCCCTGGCCCACCCTCGTGACCACCCTGGGCTACGG CGTGCAGTGCTTCGCCCGCTACCCCGACCACATGAAGCAGCACGACTTCTTCAAGTCCGCC ATGCCCGAAGGCTACGTCCAGGAGCGCACCATCTTCTTCAAGGACGACGGCAACTACAAGA CCCGCGCCGAGGTGAAGTTCGAGGGCGACACCCTGGTGAACCGCATCGAGCTGAAGGGCA TCGACTTCAAGGAGGACGGCAACATCCTGGGGCACAAGCTGGAGTACAACTACAACAGCCA CAACGTCTATATCACCGCCGACAAGCAGAAGAACGGCATCAAGGCCAACTTCAAGATCCGCC ACAACATCGAGGACGGCGGCGTGCAGCTCGCCGACCACTACCAGCAGAACACCCCCATCGG CGACGGCCCCGTGCTGCTGCCCGACAACCACTACCTGAGCTACCAGTCCAAGCTGAGCAAA GACCCCAACGAGAAGCGCGATCACATGGTCCTGCTGGAGTTCGTGACCGCCGCCGGGATCA CTCTCGGCATGGACGAGCTGTACAAGTAAGTCGACGGCGCGCCGCGGCCGCGAATTCGATA TCATAATCAACCTCTGGATTACAAAATTTGTGAAAGATTGACTGGTATTCTTAACTATGTTGCT CCTTTTACGCTATGTGGATACGCTGCTTTAATGCCTTTGTATCATGCTATTGCTTCCCGTATGG CTTTCATTTTCTCCTCCTTGTATAAATCCTGGTTAGTTCTTGCCACGGCGGAACTCATCGCCG CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCGC (SEQ ID NO: 182) |
| CN2094 (2071) <br> GCGGCCGCACGCGTTCATGAGACTCCCCTGGGGGAGAAGAGAGAGTCAGAGAGTCAGACT GTCATGCCCAGAGAGTGGCTGGCTCCTACCCCCGGAAATGGGCCTCTTACTGTGACTGCCC TGGGGCCAGCCGAACAGCTGCGTTGGCCGAGCAGGAAGTGGTGAACAGGCTGGACCCTGT |

| Fig 26 cont'd |
| --- |
| Vector ID (length between ITRs) & Sequence Between ITRs |

TCCAGCACGTTGTGGGGGAAAGAAAGAAAAAAGAAAAAAAAAGTTCCATCAGAGAAACTGCA
CGCTAGCTTAGGCCAAGGCTGATCACTGACCTCCTGTGTGGTACAATCGATCTGGACCAACC
ACTTCCCCCTTATTCTTCCCCGTATGGGAAAGTCGGTGCAGGTGCGCAGGGCCACACAAAGC
AGCTTGGGAGATAGCAGCCCAGGAAAAATAATTCCACCTGTAAACACCTGTGTTAACAAGTG
CTGTATTTGTTCAGCTATTTTCTTTTTCAAACACTGTTTACACACACCTATTCTCTTACCTCGGT
CAGGTGTGTCTTGCATGGCATCTGGGGACCCACTGGCAGGAGTCCAGGGTGCCTCAGAAAT
GCCTGTGTCCTCTGCCCAGCAATGTAGGGCTGGGACTGCCAGGCTCTCAGCTGGAGTGCCA
GTGCTGCTGGGTCAGCCTCTTGGAATGCTTTCAGGTCCCTAGGTGCTTAAGGTTGGGAGACT
TCACGTGACCAGAAGGGCCTGTCCGGGGGACAGTGACCCCAGCTGGATGGAGCTCGGGCT
GGGCATAAAAGTCAGGGCAGAGCCATCTATTGCTTACATTTGCTTCTGGGATCCAGATCTTTC
GAAGCTAGCGCTACCGGTCGCCACCATGGTGAGCAAGGGCGAGGAGCTGTTCACCGGGGT
GGTGCCCATCCTGGTCGAGCTGGACGGCGACGTAAACGGCCACAAGTTCAGCGTGTCCGGC
GAGGGCGAGGGCGATGCCACCTACGGCAAGCTGACCCTGAAGCTGATCTGCACCACCGGC
AAGCTGCCCGTGCCCTGGCCCACCCTCGTGACCACCCTGGGCTACGGCGTGCAGTGCTTCG
CCCGCTACCCCGACCACATGAAGCAGCACGACTTCTTCAAGTCCGCCATGCCCGAAGGCTA
CGTCCAGGAGCGCACCATCTTCTTCAAGGACGACGGCAACTACAAGACCCGCGCCGAGGTG
AAGTTCGAGGGCGACACCCTGGTGAACCGCATCGAGCTGAAGGGCATCGACTTCAAGGAGG
ACGGCAACATCCTGGGGCACAAGCTGGAGTACAACTACAACAGCCACAACGTCTATATCACC
GCCGACAAGCAGAAGAACGGCATCAAGGCCAACTTCAAGATCCGCCACAACATCGAGGACG
GCGGCGTGCAGCTCGCCGACCACTACCAGCAGAACACCCCCATCGGCGACGGCCCCGTGC
TGCTGCCCGACAACCACTACCTGAGCTACCAGTCCAAGCTGAGCAAAGACCCCAACGAGAA
GCGCGATCACATGGTCCTGCTGGAGTTCGTGACCGCCGCCGGGATCACTCTCGGCATGGAC
GAGCTGTACAAGTAAGTCGACGGCGCGCCGCGGCCGCGAATTCGATATCATAATCAACCTCT
GGATTACAAAATTTGTGAAAGATTGACTGGTATTCTTAACTATGTTGCTCCTTTTACGCTATGT
GGATACGCTGCTTTAATGCCTTTGTATCATGCTATTGCTTCCCGTATGGCTTTCATTTTCTCCT
CCTTGTATAAATCCTGGTTAGTTCTTGCCACGGCGGAACTCATCGCCGCCTGCCTTGCCCGC
TGCTGGACAGGGGCTCGGCTGTTGGGCACTGACAATTCCGTGGCTCGAGAGATCTTCGACT
GTGCCTTCTAGTTGCCAGCCATCTGTTGTTTGCCCCTCCCCCGTGCCTTCCTTGACCCTGGA
AGGTGCCACTCCCACTGTCCTTTCCTAATAAAATGAGGAAATTGCATCGCATTGTCTGAGTAG
GTGTCATTCTATTCTGGGGGGTGGGGTGGGGCAGGACAGCAAGGGGGAGGATTGGGAAGA
CAATAGCAGGCATGAGATCTCACGTGCGGACCGAGCGGCCGC (SEQ ID NO: 183)

CN2095 (1721)
GCGGCCGCACGCGTGCTGCCCCTTGGGGTCTTTTAAGCTACTGAAAACTCTGTGGAGACAG
CAAGTCAAAGGCCTCCTACAGACGGGAAGCAGAAGTGATGCTGAAGGGAGCCATGGGGGCA
CCTGGGACTGTTCAATGCCGAAAGTGACTGGATTGAAAGAAGCACCAGAAAGACAGGGAAG
ACCTGAAGTCACCTCCCTGTCCTCTCTAGACACCGGAATCTTCAGCTAAGAGAAGTGAATGTA
TGAGACACCTTCTCTTCCTCATGGGTCTGAAGAGATATTGAGAGGACGGAAGCTAGACACAG
TCTGCAGGAGGGACAGATGGATTCAAAGGGGCAGGTCTCGGAGGCTACGTGACAAGGTCTG
GTGCCTGGGAGCTCGGGCTGGGCATAAAAGTCAGGGCAGAGCCATCTATTGCTTACATTTGC
TTCTGGGATCCAGATCTTTCGAAGCTAGCGCTACCGGTCGCCACCATGGTGAGCAAGGGCG
AGGAGCTGTTCACCGGGGTGGTGCCCATCCTGGTCGAGCTGGACGGCGACGTAAACGGCC
ACAAGTTCAGCGTGTCCGGCGAGGGCGAGGGCGATGCCACCTACGGCAAGCTGACCCTGA
AGCTGATCTGCACCACCGGCAAGCTGCCCGTGCCCTGGCCCACCCTCGTGACCACCCTGGG
CTACGGCGTGCAGTGCTTCGCCCGCTACCCCGACCACATGAAGCAGCACGACTTCTTCAAGT
CCGCCATGCCCGAAGGCTACGTCCAGGAGCGCACCATCTTCTTCAAGGACGACGGCAACTA
CAAGACCCGCGCCGAGGTGAAGTTCGAGGGCGACACCCTGGTGAACCGCATCGAGCTGAA
GGGCATCGACTTCAAGGAGGACGGCAACATCCTGGGGCACAAGCTGGAGTACAACTACAAC
AGCCACAACGTCTATATCACCGCCGACAAGCAGAAGAACGGCATCAAGGCCAACTTCAAGAT
CCGCCACAACATCGAGGACGGCGGCGTGCAGCTCGCCGACCACTACCAGCAGAACACCCC

| Fig 26 cont'd |
| --- |
| Vector ID (length between ITRs) & Sequence Between ITRs |
| CATCGGCGACGGCCCCGTGCTGCTGCCCGACAACCACTACCTGAGCTACCAGTCCAAGCTG AGCAAAGACCCCAACGAGAAGCGCGATCACATGGTCCTGCTGGAGTTCGTGACCGCCGCCG GGATCACTCTCGGCATGGACGAGCTGTACAAGTAAGTCGACGGCGCGCCGCGGCCGCGAAT TCGATATCATAATCAACCTCTGGATTACAAAATTTGTGAAAGATTGACTGGTATTCTTAACTAT GTTGCTCCTTTTACGCTATGTGGATACGCTGCTTTAATGCCTTTGTATCATGCTATTGCTTCCC GTATGGCTTTCATTTTCTCCTCCTTGTATAAATCCTGGTTAGTTCTTGCCACGGCGGAACTCAT CGCCGCCTGCCTTGCCCGCTGCTGGACAGGGGCTCGGCTGTTGGGCACTGACAATTCCGTG GCTCGAGAGATCTTCGACTGTGCCTTCTAGTTGCCAGCCATCTGTTGTTTGCCCCTCCCCCG TGCCTTCCTTGACCCTGGAAGGTGCCACTCCCACTGTCCTTTCCTAATAAAATGAGGAAATTG CATCGCATTGTCTGAGTAGGTGTCATTCTATTCTGGGGGGTGGGGTGGGGCAGGACAGCAA GGGGGAGGATTGGGAAGACAATAGCAGGCATGAGATCTCACGTGCGGACCGAGCGGCCGC (SEQ ID NO: 184) |
| CN2096 (1842)<br>GCGGCCGCACGCGTAAAGCCTCGGGTCTCTGTCCCACCTAGAGATTTCGGTCTCTAGAAATG GCAGCCACCTGCTCACACCCCAGGCACCCTTACTCCACCCCGAGATTCTGACATCACCTTCT GCTGTGACCAATGAATGGAGTCCCAGCAATGATGAGGATGTGAATGCCAGCTACCTCCCCCA CCCGAGGCCTGTGGTTGCAAAGATGCTCTAACAGGAAGCGGGTTTGAGGAGCTGCACAGCT TCCTGCTCCCCCTCGAGCTGCACAGGACGAGAAGGGCTAGCGCTCAGCTTGGCCACGAGAC ACAGCTTCATGCCAGGGTTCTGGTAGCTTCCTCTTCCATATCTACTTCCGTGTGGCCCCAGG GGCCCCCCAGAGGCAAGCGCTGCTGTCCCTTGCCCAGGCCACCCTCCACCTCCAGTTTGGA GCCCTGCCCCCCCTGGGGCTGGGCCAAGCCCAACTACTGACTGGGATTCCATGGGGGACT GGTAGGTGAGCTCGGGCTGGGCATAAAAGTCAGGGCAGAGCCATCTATTGCTTACATTTGCT TCTGGGATCCAGATCTTTCGAAGCTAGCGCTACCGGTCGCCACCATGGTGAGCAAGGGCGA GGAGCTGTTCACCGGGGTGGTGCCCATCCTGGTCGAGCTGGACGGCGACGTAAACGGCCA CAAGTTCAGCGTGTCCGGCGAGGGCGAGGGCGATGCCACCTACGGCAAGCTGACCCTGAA GCTGATCTGCACCACCGGCAAGCTGCCCGTGCCCTGGCCCACCCTCGTGACCACCCTGGGC TACGGCGTGCAGTGCTTCGCCCGCTACCCCGACCACATGAAGCAGCACGACTTCTTCAAGTC CGCCATGCCCGAAGGCTACGTCCAGGAGCGCACCATCTTCTTCAAGGACGACGGCAACTAC AAGACCCGCGCCGAGGTGAAGTTCGAGGGCGACACCCTGGTGAACCGCATCGAGCTGAAG GGCATCGACTTCAAGGAGGACGGCAACATCCTGGGGCACAAGCTGGAGTACAACTACAACA GCCACAACGTCTATATCACCGCCGACAAGCAGAAGAACGGCATCAAGGCCAACTTCAAGATC CGCCACAACATCGAGGACGGCGGCGTGCAGCTCGCCGACCACTACCAGCAGAACACCCCC ATCGGCGACGGCCCCGTGCTGCTGCCCGACAACCACTACCTGAGCTACCAGTCCAAGCTGA GCAAAGACCCCAACGAGAAGCGCGATCACATGGTCCTGCTGGAGTTCGTGACCGCCGCCGG GATCACTCTCGGCATGGACGAGCTGTACAAGTAAGTCGACGGCGCGCCGCGGCCGCGAATT CGATATCATAATCAACCTCTGGATTACAAAATTTGTGAAAGATTGACTGGTATTCTTAACTATG TTGCTCCTTTTACGCTATGTGGATACGCTGCTTTAATGCCTTTGTATCATGCTATTGCTTCCCG TATGGCTTTCATTTTCTCCTCCTTGTATAAATCCTGGTTAGTTCTTGCCACGGCGGAACTCATC GCCGCCTGCCTTGCCCGCTGCTGGACAGGGGCTCGGCTGTTGGGCACTGACAATTCCGTGG CTCGAGAGATCTTCGACTGTGCCTTCTAGTTGCCAGCCATCTGTTGTTTGCCCCTCCCCCGT GCCTTCCTTGACCCTGGAAGGTGCCACTCCCACTGTCCTTTCCTAATAAAATGAGGAAATTGC ATCGCATTGTCTGAGTAGGTGTCATTCTATTCTGGGGGGTGGGGTGGGGCAGGACAGCAAG GGGGAGGATTGGGAAGACAATAGCAGGCATGAGATCTCACGTGCGGACCGAGCGGCCGC (SEQ ID NO: 185) |
| CN2097 (1703)<br>GCGGCCGCACGCGTAGGGAAGGCAGCAGTCTTGGCACCACCAGGAGACTATGCAGACAAG AGCTGGGGGTTCAGGCCAACGAGGAATCAAGGACTTAAGAGACCAAGGTCGTTTAAAATAAAG AGGCACAGAGAAGGAAGCCTGGCATTCTCTGGTAATGCACCTTAGGCATGGGCCAATTCTTC ATTGAGCAATGTCAGAGGTTAAGAAGCTCAGTAAACTGCAGCTGAACAGAGAAGTGAGATCT |

| Fig 26 cont'd |
| --- |
| Vector ID (length between ITRs) & Sequence Between ITRs |
| GGCAATCTCACAACACTGAGTAAACAGAAATCGGAATTCAGGGCTGCCAAGGAGAAAGAGGT<br>CATTTGTAAACACTCCAGCCTTTTTAGTTTGTCTGGGTCCTTGGCAAAGCTGAGCTCGGGCTG<br>GGCATAAAAGTCAGGGCAGAGCCATCTATTGCTTACATTTGCTTCTGGGATCCAGATCTTTCG<br>AAGCTAGCGCTACCGGTCGCCACCATGGTGAGCAAGGGCGAGGAGCTGTTCACCGGGGTG<br>GTGCCCATCCTGGTCGAGCTGGACGGCGACGTAAACGGCCACAAGTTCAGCGTGTCCGGCG<br>AGGGCGAGGGCGATGCCACCTACGGCAAGCTGACCCTGAAGCTGATCTGCACCACCGGCAA<br>GCTGCCCGTGCCCTGGCCCACCCTCGTGACCACCCTGGGCTACGGCGTGCAGTGCTTCGC<br>CCGCTACCCCGACCACATGAAGCAGCACGACTTCTTCAAGTCCGCCATGCCCGAAGGCTAC<br>GTCCAGGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATATCACCG<br>CCGACAAGCAGAAGAACGGCATCAAGGCCAACTTCAAGATCCGCCACAACATCGAGGACGG<br>CGGCGTGCAGCTCGCCGACCACTACCAGCAGAACACCCCCATCGGCGACGGCCCCGTGCT<br>GCTGCCCGACAACCACTACCTGAGCTACCAGTCCAAGCTGAGCAAAGACCCCAACGAGAAG<br>CGCGATCACATGGTCCTGCTGGAGTTCGTGACCGCCGCCGGGATCACTCTCGGCATGGACG<br>AGCTGTACAAGTAAGTCGACGGCGCGCCGCGGCCGCGAATTCGATATCATAATCAACCTCTG<br>GATTACAAAATTTGTGAAAGATTGACTGGTATTCTTAACTATGTTGCTCCTTTTACGCTATGTG<br>GATACGCTGCTTTAATGCCTTTGTATCATGCTATTGCTTCCCGTATGGCTTTCATTTTCTCCTC<br>CTTGTATAAATCCTGGTTAGTTCTTGCCACGGCGGAACTCATCGCCGCCTGCCTTGCCCGCT<br>GCTGGACAGGGGCTCGGCTGTTGGGCACTGACAATTCCGTGGCTCGAGAGATCTTCGACTG<br>TGCCTTCTAGTTGCCAGCCATCTGTTGTTTGCCCCTCCCCCGTGCCTTCCTTGACCCTGGAA<br>GGTGCCACTCCCACTGTCCTTTCCTAATAAAATGAGGAAATTGCATCGCATTGTCTGAGTAGG<br>TGTCATTCTATTCTGGGGGGTGGGGTGGGGCAGGACAGCAAGGGGGAGGATTGGGAAGAC<br>AATAGCAGGCATGAGATCTCACGTGCGGACCGAGCGGCCGC (SEQ ID NO: 186) |
| CN2098 (1650)<br>GCGGCCGCACGCGTGATGGGTGGGACCAGGAAGGGACTGGGCAGGAGCTCATTTTGGGAT<br>AGGGGAGGGGACAGCTGAGGGGTTACAGATGGAGTAAAGCAAAGCCCAGGCATCCTATGG<br>GAGGTCTGGCTAAAAGCCAGGGTCCTACTTGCCCCCACGCTCCACCCAACTCAATCCCTGCC<br>CCTTAGACCTCCTCCCACCAGGGGGCTGGCTACACCCCAGTAAGTTTTAACAAGGCACCCCT<br>CCCCTTGGCAGGACTCACAGGGAAGGTTTTGTCTTGCTCAGCCCAGTTTCTCCAGCGCCTCT<br>GAGCTCGGGCTGGGCATAAAAGTCAGGGCAGAGCCATCTATTGCTTACATTTGCTTCTGGGA<br>TCCAGATCTTTCGAAGCTAGCGCTACCGGTCGCCACCATGGTGAGCAAGGGCGAGGAGCTG<br>TTCACCGGGGTGGTGCCCATCCTGGTCGAGCTGGACGGCGACGTAAACGGCCACAAGTTCA<br>GCGTGTCCGGCGAGGGCGAGGGCGATGCCACCTACGGCAAGCTGACCCTGAAGCTGATCT<br>GCACCACCGGCAAGCTGCCCGTGCCCTGGCCCACCCTCGTGACCACCCTGGGCTACGGCG<br>TGCAGTGCTTCGCCCGCTACCCCGACCACATGAAGCAGCACGACTTCTTCAAGTCCGCCATG<br>CCCGAAGGCTACGTCCAGGAGCGCACCATCTTCTTCAAGGACGACGGCAACTACAAGACCC<br>GCGCCGAGGTGAAGTTCGAGGGCGACACCCTGGTGAACCGCATCGAGCTGAAGGGCATCG<br>ACTTCAAGGAGGACGGCAACATCCTGGGGCACAAGCTGGAGTACAACTACAACAGCCACAA<br>CGTCTATATCACCGCCGACAAGCAGAAGAACGGCATCAAGGCCAACTTCAAGATCCGCCACA<br>ACATCGAGGACGGCGGCGTGCAGCTCGCCGACCACTACCAGCAGAACACCCCCATCGGCG<br>ACGGCCCCGTGCTGCTGCCCGACAACCACTACCTGAGCTACCAGTCCAAGCTGAGCAAAGA<br>CCCCAACGAGAAGCGCGATCACATGGTCCTGCTGGAGTTCGTGACCGCCGCCGGGATCACT<br>CTCGGCATGGACGAGCTGTACAAGTAAGTCGACGGCGCGCCGCGGCCGCGAATTCGATATC<br>ATAATCAACCTCTGGATTACAAAATTTGTGAAAGATTGACTGGTATTCTTAACTATGTTGCTCC<br>TTTTACGCTATGTGGATACGCTGCTTTAATGCCTTTGTATCATGCTATTGCTTCCCGTATGGCT<br>TTCATTTTCTCCTCCTTGTATAAATCCTGGTTAGTTCTTGCCACGGCGGAACTCATCGCCGCC<br>TGCCTTGCCCGCTGCTGGACAGGGGCTCGGCTGTTGGGCACTGACAATTCCGTGGCTCGAG<br>AGATCTTCGACTGTGCCTTCTAGTTGCCAGCCATCTGTTGTTTGCCCCTCCCCCGTGCCTTCC |

| Fig 26 cont'd |
| --- |
| Vector ID (length between ITRs) & Sequence Between ITRs |
| TTGACCCTGGAAGGTGCCACTCCCACTGTCCTTTCCTAATAAAATGAGGAAATTGCATCGCAT TGTCTGAGTAGGTGTCATTCTATTCTGGGGGGGTGGGGTGGGGCAGGACAGCAAGGGGGAG GATTGGGAAGACAATAGCAGGCATGAGATCTCACGTGCGGACCGAGCGGCCGC (SEQ ID NO: 187) |
| CN2099 (1678)<br>GCGGCCGCACGCGTTCCATGGCTTCCACAGTCACTCTGCCTAGTTCTCTCCCCACCACTCAG TTGGTACCACTGGGCCCCAAGGCAGCAAGAGAGTCAATGGCTCCTTTTCTCTGTGAGTGTGA TGGATCTGGGGTGGGGGAGGAGATGTCCAATAGCTGTCTTTGCAGCAGCCATAGACACAAT GTACAAAGCCCATCTTGTTCTTTAGCCTGAGCTTCAGGTCCAACAATATACACTATGGGGACA GGAGAGCAATCCCCAGCTACAGCTATCTATCTGCAGGGATGCTTGACATTCTGCTCTGGGTA ACAGGGCTAGGGTTGTTCAGCTGAGAGCTCGGGCTGGGCATAAAAGTCAGGGCAGAGCCAT CTATTGCTTACATTTGCTTCTGGGATCCAGATCTTTCGAAGCTAGCGCTACCGGTCGCCACCA TGGTGAGCAAGGGCGAGGAGCTGTTCACCGGGGTGGTGCCCATCCTGGTCGAGCTGGACG GCGACGTAAACGGCCACAAGTTCAGCGTGTCCGGCGAGGGCGAGGGCGATGCCACCTACG GCAAGCTGACCCTGAAGCTGATCTGCACCACCGGCAAGCTGCCCGTGCCCTGGCCCACCCT CGTGACCACCCTGGGCTACGGCGTGCAGTGCTTCGCCCGCTACCCCGACCACATGAAGCAG CACGACTTCTTCAAGTCCGCCATGCCCGAAGGCTACGTCCAGGAGCGCACCATCTTCTTCAA GGACGACGGCAACTACAAGACCCGCGCCGAGGTGAAGTTCGAGGGCGACACCCTGGTGAA CCGCATCGAGCTGAAGGGCATCGACTTCAAGGAGGACGGCAACATCCTGGGGCACAAGCTG GAGTACAACTACAACAGCCACAACGTCTATATCACCGCCGACAAGCAGAAGAACGGCATCAA GGCCAACTTCAAGATCCGCCACAACATCGAGGACGGCGGCGTGCAGCTCGCCGACCACTAC CAGCAGAACACCCCCATCGGCGACGGCCCCGTGCTGCTGCCCGACAACCACTACCTGAGCT ACCAGTCCAAGCTGAGCAAAGACCCCAACGAGAAGCGCGATCACATGGTCCTGCTGGAGTT CGTGACCGCCGCCGGGATCACTCTCGGCATGGACGAGCTGTACAAGTAAGTCGACGGCGC GCCGCGGCCGCGAATTCGATATCATAATCAACCTCTGGATTACAAAATTTGTGAAAGATTGAC TGGTATTCTTAACTATGTTGCTCCTTTTACGCTATGTGGATACGCTGCTTTAATGCCTTTGTAT CATGCTATTGCTTCCCGTATGGCTTTCATTTTCTCCTCCTTGTATAAATCCTGGTTAGTTCTTG CCACGGCGGAACTCATCGCCGCCTGCCTTGCCCGCTGCTGGACAGGGGCTCGGCTGTTGG GCACTGACAATTCCGTGGCTCGAGAGATCTTCGACTGTGCCTTCTAGTTGCCAGCCATCTGT TGTTTGCCCCTCCCCCGTGCCTTCCTTGACCCTGGAAGGTGCCACTCCCACTGTCCTTTCCT AATAAAATGAGGAAATTGCATCGCATTGTCTGAGTAGGTGTCATTCTATTCTGGGGGGTGGG GTGGGGCAGGACAGCAAGGGGGAGGATTGGGAAGACAATAGCAGGCATGAGATCTCACGT GCGGACCGAGCGGCCGC (SEQ ID NO: 188) |
| CN2100 (1600)<br>GCGGCCGCACGCGTCAGGGCTGTCTCAGTTGCCTAGGAACACTTAGTTAATAGTGATTCCTT CCAGGGCGCTTCAGTTCACTGCTGACCTCACTGATGATGAGTAGTTGAACAAATAAGGGAAA GAACACTAGAGACGTTTTTGGCTTCTCTTTCACTGAAAGCATGGAAGAGGCCAAGAAGTTTTT GCCCACGGAGTAGGAAAGAAAGTAGGACATGGAAACATCTTTTATCAAGCTTCTTACAATTGA GCCTTCGAGCTCGGGCTGGGCATAAAAGTCAGGGCAGAGCCATCTATTGCTTACATTTGCTT CTGGGATCCAGATCTTTCGAAGCTAGCGCTACCGGTCGCCACCATGGTGAGCAAGGGCGAG GAGCTGTTCACCGGGGTGGTGCCCATCCTGGTCGAGCTGGACGGCGACGTAAACGGCCAC AAGTTCAGCGTGTCCGGCGAGGGCGAGGGCGATGCCACCTACGGCAAGCTGACCCTGAAG CTGATCTGCACCACCGGCAAGCTGCCCGTGCCCTGGCCCACCCTCGTGACCACCCTGGGCT ACGGCGTGCAGTGCTTCGCCCGCTACCCCGACCACATGAAGCAGCACGACTTCTTCAAGTC CGCCATGCCCGAAGGCTACGTCCAGGAGCGCACCATCTTCTTCAAGGACGACGGCAACTAC AAGACCCGCGCCGAGGTGAAGTTCGAGGGCGACACCCTGGTGAACCGCATCGAGCTGAAG GGCATCGACTTCAAGGAGGACGGCAACATCCTGGGGCACAAGCTGGAGTACAACTACAACA GCCACAACGTCTATATCACCGCCGACAAGCAGAAGAACGGCATCAAGGCCAACTTCAAGATC CGCCACAACATCGAGGACGGCGGCGTGCAGCTCGCCGACCACTACCAGCAGAACACCCCC |

| Fig 26 cont'd |
| Vector ID (length between ITRs) & Sequence Between ITRs |

ATCGGCGACGGCCCCGTGCTGCTGCCCGACAACCACTACCTGAGCTACCAGTCCAAGCTGA
GCAAAGACCCCAACGAGAAGCGCGATCACATGGTCCTGCTGGAGTTCGTGACCGCCGCCGG
GATCACTCTCGGCATGGACGAGCTGTACAAGTAAGTCGACGGCGCGCCGCGGCCGCGAATT
CGATATCATAATCAACCTCTGGATTACAAAATTTGTGAAAGATTGACTGGTATTCTTAACTATG
TTGCTCCTTTTACGCTATGTGGATACGCTGCTTTAATGCCTTTGTATCATGCTATTGCTTCCCG
TATGGCTTTCATTTTCTCCTCCTTGTATAAATCCTGGTTAGTTCTTGCCACGGCGGAACTCATC
GCCGCCTGCCTTGCCCGCTGCTGGACAGGGGCTCGGCTGTTGGGCACTGACAATTCCGTGG
CTCGAGAGATCTTCGACTGTGCCTTCTAGTTGCCAGCCATCTGTTGTTTGCCCCTCCCCCGT
GCCTTCCTTGACCCTGGAAGGTGCCACTCCCACTGTCCTTTCCTAATAAAATGAGGAAATTGC
ATCGCATTGTCTGAGTAGGTGTCATTCTATTCTGGGGGGTGGGGTGGGGCAGGACAGCAAG
GGGGAGGATTGGGAAGACAATAGCAGGCATGAGATCTCACGTGCGGACCGAGCGGCCGC
(SEQ ID NO: 189)

CN2101 (1837)
GCGGCCGCACGCGTTTAGCGGGCAAAGGACGTTTATTTGATGAGGGGTAGGAGCTTGGTCA
ATTCTGTGATCCCTAGATTAGATTGTTGGGCAGACACACCCACTTTTCAGAGAGGCCATTGGC
TCCTGTGTGAAAGATACTCCCACAGCAAATGGGGGAGGGCTGGCAGCCTCATTTGGCTTTCT
GCCATCTCTCAGAGCTGGGTCCTGGTGTGCTTTGGGGAAGCGTCTCTGGCAGATCCCTGCT
AGCTAGTGTTTCCTGACATTTGTTTCAGAGACCTTAATAAGGTTACTGGAAAAAAAATTTTCTC
TCTTAAAATAGGTTCACTAAGCTCTGGGTTCTGCCAGGCAAGTAAGTCTTTCACTGGGTCTTG
GATCTGCAGGGGGCTTCAGACCCCTTCCAGAGGAGGGGTTGCCTCTGCAGAGGTCTACTGA
GCAGAAAGGGACAAGATGGGAACCTTCTTTGTGAAGCTCACTTGGTTTCAGCACCTGCGAGC
TCGGGCTGGGCATAAAAGTCAGGGCAGAGCCATCTATTGCTTACATTTGCTTCTGGGATCCA
GATCTTTCGAAGCTAGCGCTACCGGTCGCCACCATGGTGAGCAAGGGCGAGGAGCTGTTCA
CCGGGGTGGTGCCCATCCTGGTCGAGCTGGACGGCGACGTAAACGGCCACAAGTTCAGCG
TGTCCGGCGAGGGCGAGGGCGATGCCACCTACGGCAAGCTGACCCTGAAGCTGATCTGCA
CCACCGGCAAGCTGCCCGTGCCCTGGCCCACCCTCGTGACCACCCTGGGCTACGGCGTGC
AGTGCTTCGCCCGCTACCCCGACCACATGAAGCAGCACGACTTCTTCAAGTCCGCCATGCCC
GAAGGCTACGTCCAGGAGCGCACCATCTTCTTCAAGGACGACGGCAACTACAAGACCCGCG
CCGAGGTGAAGTTCGAGGGCGACACCCTGGTGAACCGCATCGAGCTGAAGGGCATCGACTT
CAAGGAGGACGGCAACATCCTGGGGCACAAGCTGGAGTACAACTACAACAGCCACAACGTC
TATATCACCGCCGACAAGCAGAAGAACGGCATCAAGGCCAACTTCAAGATCCGCCACAACAT
CGAGGACGGCGGCGTGCAGCTCGCCGACCACTACCAGCAGAACACCCCCATCGGCGACGG
CCCCGTGCTGCTGCCCGACAACCACTACCTGAGCTACCAGTCCAAGCTGAGCAAAGACCCC
AACGAGAAGCGCGATCACATGGTCCTGCTGGAGTTCGTGACCGCCGCCGGGATCACTCTCG
GCATGGACGAGCTGTACAAGTAAGTCGACGGCGCGCCGCGGCCGCGAATTCGATATCATAA
TCAACCTCTGGATTACAAAATTTGTGAAAGATTGACTGGTATTCTTAACTATGTTGCTCCTTTT
ACGCTATGTGGATACGCTGCTTTAATGCCTTTGTATCATGCTATTGCTTCCCGTATGGCTTTC
ATTTTCTCCTCCTTGTATAAATCCTGGTTAGTTCTTGCCACGGCGGAACTCATCGCCGCCTGC
CTTGCCCGCTGCTGGACAGGGGCTCGGCTGTTGGGCACTGACAATTCCGTGGCTCGAGAGA
TCTTCGACTGTGCCTTCTAGTTGCCAGCCATCTGTTGTTTGCCCCTCCCCCGTGCCTTCCTTG
ACCCTGGAAGGTGCCACTCCCACTGTCCTTTCCTAATAAAATGAGGAAATTGCATCGCATTGT
CTGAGTAGGTGTCATTCTATTCTGGGGGGTGGGGTGGGGCAGGACAGCAAGGGGGAGGATT
GGGAAGACAATAGCAGGCATGAGATCTCACGTGCGGACCGAGCGGCCGC (SEQ ID NO: 190)

CN2102 (1850)
GCGGCCGCACGCGTTGGCTCTGGCAAAGGATGGAGATTTTTTTTTTAACCTATTCTTTTGAGA
ATAAGGAGGGTCTTTGTTTCTCTTCCCTGGGAACCGAGCAGCCCCTTTCTCTGAGGGTAGAG
TTGGGGCATGGCTCAGCAGAACGACAGTCATCCTGGCTAGTAAGACTCAGAGGCTGGCCTT
CAAAGGCTTGAGCTCCTGGGTGACTGAGCAGTGGAGAAACAGAATCCTGCCCTTGAATTGCT
CCCCAGGCGGGCTTTATGCAGTCTGGGGAAGCAAGGGATGCCCTGTGATTCTTAAAGAAACT

| Fig 26 cont'd |
| --- |
| Vector ID (length between ITRs) & Sequence Between ITRs |
| GGTATAATTTTGCACTGCATAGCAGACTCCCAAGACACACAGCCTTTTCCAGGAGGAGTTCCT TAGAGGGGAAGGGGATAGGTTGCAATGGTCTGCTTAGCCTCCCGAAGGCTGCAGAAGCTGC TAAGACAGGGGTAACTGAAAGATAGACTCTGTGAGGTTGAACAGCAATCTTTATGACCTGAC CCCCTAGGCAGAGCTCGGGCTGGGCATAAAAGTCAGGGCAGAGCCATCTATTGCTTACATTT GCTTCTGGGATCCAGATCTTTCGAAGCTAGCGCTACCGGTCGCCACCATGGTGAGCAAGGG CGAGGAGCTGTTCACCGGGGTGGTGCCCATCCTGGTCGAGCTGGACGGCGACGTAAACGG CCACAAGTTCAGCGTGTCCGGCGAGGGCGAGGGCGATGCCACCTACGGCAAGCTGACCCT GAAGCTGATCTGCACCACCGGCAAGCTGCCCGTGCCCTGGCCCACCCTCGTGACCACCCTG GGCTACGGCGTGCAGTGCTTCGCCCGCTACCCCGACCACATGAAGCAGCACGACTTCTTCA AGTCCGCCATGCCCGAAGGCTACGTCCAGGAGCGCACCATCTTCTTCAAGGACGACGGCAA CTACAAGACCCGCGCCGAGGTGAAGTTCGAGGGCGACACCCTGGTGAACCGCATCGAGCTG AAGGGCATCGACTTCAAGGAGGACGGCAACATCCTGGGGCACAAGCTGGAGTACAACTACA ACAGCCACAACGTCTATATCACCGCCGACAAGCAGAAGAACGGCATCAAGGCCAACTTCAAG ATCCGCCACAACATCGAGGACGGCGGCGTGCAGCTCGCCGACCACTACCAGCAGAACACCC CCATCGGCGACGGCCCCGTGCTGCTGCCCGACAACCACTACCTGAGCTACCAGTCCAAGCT GAGCAAAGACCCCAACGAGAAGCGCGATCACATGGTCCTGCTGGAGTTCGTGACCGCCGCC GGGATCACTCTCGGCATGGACGAGCTGTACAAGTAAGTCGACGGCGCGCCGCGGCCGCGA ATTCGATATCATAATCAACCTCTGGATTACAAAATTTGTGAAAGATTGACTGGTATTCTTAACT ATGTTGCTCCTTTTACGCTATGTGGATACGCTGCTTTAATGCCTTTGTATCATGCTATTGCTTC CCGTATGGCTTTCATTTTCTCCTCCTTGTATAAATCCTGGTTAGTTCTTGCCACGGCGGAACT CATCGCCGCCTGCCTTGCCCGCTGCTGGACAGGGGCTCGGCTGTTGGGCACTGACAATTCC GTGGCTCGAGAGATCTTCGACTGTGCCTTCTAGTTGCCAGCCATCTGTTGTTTGCCCCTCCC CCGTGCCTTCCTTGACCCTGGAAGGTGCCACTCCCACTGTCCTTTCCTAATAAAATGAGGAA ATTGCATCGCATTGTCTGAGTAGGTGTCATTCTATTCTGGGGGGTGGGGTGGGGCAGGACA GCAAGGGGGAGGATTGGGAAGACAATAGCAGGCATGAGATCTCACGTGCGGACCGAGCGG CCGC (SEQ ID NO: 191) |
| CN2103 (1792) GCGGCCGCACGCGTACTGGTGAGTGAGTTGTGCAGTTTGCAAAACTTGGAGGTCTCCCTGG AAACAGAATAAAATGCTGCAGTGTGATGTCCAGAGGGAGGGGGCTTTTATCCCACCTCATAA TTAAATCTGAAAGGTTCCTGGGGCGAGCTAAGAGGTTTCTAATGAAGTACTAAGCTGTGCTTG GAGTCTGCACCACGAAAGGCGCTTTGTTCTCCTTTCAAAAGGTTCCAGTGCTGAATAATTTGG CTCCCAGCGCTGGCTAGTTTCAGACCACCTGCAGATTCTAATCTACGCAAATTTATTTGGTAC AAACTTTCTTCTACGTCACTTGGTTCAGCATAATTCCAGAGAGGTTTATTGCTAATGTTTAACA GCCATCAGAGAACAGCTGCTCTCCTGGGGCCTGCCCCTCGAAAGGGAAAAAGGGGGGAAAT GGGGCTTTTGTGAGCTCGGGCTGGGCATAAAAGTCAGGGCAGAGCCATCTATTGCTTACATT TGCTTCTGGGATCCAGATCTTTCGAAGCTAGCGCTACCGGTCGCCACCATGGTGAGCAAGG GCGAGGAGCTGTTCACCGGGGTGGTGCCCATCCTGGTCGAGCTGGACGGCGACGTAAACG GCCACAAGTTCAGCGTGTCCGGCGAGGGCGAGGGCGATGCCACCTACGGCAAGCTGACCC TGAAGCTGATCTGCACCACCGGCAAGCTGCCCGTGCCCTGGCCCACCCTCGTGACCACCCT GGGCTACGGCGTGCAGTGCTTCGCCCGCTACCCCGACCACATGAAGCAGCACGACTTCTTC AAGTCCGCCATGCCCGAAGGCTACGTCCAGGAGCGCACCATCTTCTTCAAGGACGACGGCA ACTACAAGACCCGCGCCGAGGTGAAGTTCGAGGGCGACACCCTGGTGAACCGCATCGAGCT GAAGGGCATCGACTTCAAGGAGGACGGCAACATCCTGGGGCACAAGCTGGAGTACAACTAC AACAGCCACAACGTCTATATCACCGCCGACAAGCAGAAGAACGGCATCAAGGCCAACTTCAA GATCCGCCACAACATCGAGGACGGCGGCGTGCAGCTCGCCGACCACTACCAGCAGAACACC CCCATCGGCGACGGCCCCGTGCTGCTGCCCGACAACCACTACCTGAGCTACCAGTCCAAGC TGAGCAAAGACCCCAACGAGAAGCGCGATCACATGGTCCTGCTGGAGTTCGTGACCGCCGC CGGGATCACTCTCGGCATGGACGAGCTGTACAAGTAAGTCGACGGCGCGCCGCGGCCGCG AATTCGATATCATAATCAACCTCTGGATTACAAAATTTGTGAAAGATTGACTGGTATTCTTAAC |

| Fig 26 cont'd |
|---|
| Vector ID (length between ITRs) & Sequence Between ITRs |
| TATGTTGCTCCTTTTACGCTATGTGGATACGCTGCTTTAATGCCTTTGTATCATGCTATTGCTT<br>CCCGTATGGCTTTCATTTTCTCCTCCTTGTATAAATCCTGGTTAGTTCTTGCCACGGCGGAAC<br>TCATCGCCGCCTGCCTTGCCCGCTGCTGGACAGGGGCTCGGCTGTTGGGCACTGACAATTC<br>CGTGGCTCGAGAGATCTTCGACTGTGCCTTCTAGTTGCCAGCCATCTGTTGTTTGCCCCTCC<br>CCCGTGCCTTCCTTGACCCTGGAAGGTGCCACTCCCACTGTCCTTTCCTAATAAAATGAGGA<br>AATTGCATCGCATTGTCTGAGTAGGTGTCATTCTATTCTGGGGGGTGGGGTGGGGCAGGACA<br>GCAAGGGGGAGGATTGGGAAGACAATAGCAGGCATGAGATCTCACGTGCGGACCGAGCGG<br>CCGC (SEQ ID NO: 192) |
| CN2104 (1953)<br>GCGGCCGCACGCGTTCCAGAAACTGAGTCTGCAGCTTCTTAGCAGTTACTTGAGAAAAGAAG<br>TAGAAGAACTGATTTGCTTTTACAGGCTTCTCAGCAGAATCTCCGTGGATTACTGTGCTGGGC<br>TTTTAGTAGCACAACACGTCAGTATGTCAGTGCTTACTCAATGCTATTTTCGGTTCTCCAAGTA<br>AAATCATGAACACTGAGCCTTTTGTTCAAAGTACCATAAGGGCATTCTGATGTCCGTTCTTAG<br>TCTGAGGTTAAAATGGAGACAGCTAAACAAGTTGTAAGATCCAACTTTCTCTCTCTCTCTCTCT<br>CTCTCTCTCTCTCTCTCTCTCTCTCTCTCTCAATCTCTCTCTCTCTCTCTCTCTCTCTCTCTC<br>TCTCTCTCTCTCTCTCTCTTTCTCTCTTTTTCTCCCTCCCTTCCCTTCTTATTTTTCGTGTTTT<br>GTATTTTTTTCCTAACAACAAACAAAAGGAAGTACTCACTTGAGGTGAGGACAAGGCTACTTA<br>TGTAAGAGTTGTGCAAGTGGAGAGGACATGCCCCCTGCTTGGAGATTAGTCCAGCAAACAAA<br>TGATCAATTTAAAGCAGGGACAAAAGTTACTGAAAGGGAGCTCGGGCTGGGCATAAAAGTCA<br>GGGCAGAGCCATCTATTGCTTACATTTGCTTCTGGGATCCAGATCTTTCGAAGCTAGCGCTAC<br>CGGTCGCCACCATGGTGAGCAAGGGCGAGGAGCTGTTCACCGGGGTGGTGCCCATCCTGG<br>TCGAGCTGGACGGCGACGTAAACGGCCACAAGTTCAGCGTGTCCGGCGAGGGCGAGGGCG<br>ATGCCACCTACGGCAAGCTGACCCTGAAGCTGATCTGCACCACCGGCAAGCTGCCCGTGCC<br>CTGGCCCACCCTCGTGACCACCCTGGGCTACGGCGTGCAGTGCTTCGCCCGCTACCCCGAC<br>CACATGAAGCAGCACGACTTCTTCAAGTCCGCCATGCCCGAAGGCTACGTCCAGGAGCGCA<br>CCATCTTCTTCAAGGACGACGGCAACTACAAGACCCGCGCCGAGGTGAAGTTCGAGGGCGA<br>CACCCTGGTGAACCGCATCGAGCTGAAGGGCATCGACTTCAAGGAGGACGGCAACATCCTG<br>GGGCACAAGCTGGAGTACAACTACAACAGCCACAACGTCTATATCACCGCCGACAAGCAGAA<br>GAACGGCATCAAGGCCAACTTCAAGATCCGCCACAACATCGAGGACGGCGGCGTGCAGCTC<br>GCCGACCACTACCAGCAGAACACCCCCATCGGCGACGGCCCCGTGCTGCTGCCCGACAAC<br>CACTACCTGAGCTACCAGTCCAAGCTGAGCAAAGACCCCAACGAGAAGCGCGATCACATGG<br>TCCTGCTGGAGTTCGTGACCGCCGCCGGGATCACTCTCGGCATGGACGAGCTGTACAAGTA<br>AGTCGACGGCGCGCCGCGGCCGCGAATTCGATATCATAATCAACCTCTGGATTACAAAATTT<br>GTGAAAGATTGACTGGTATTCTTAACTATGTTGCTCCTTTTACGCTATGTGGATACGCTGCTTT<br>AATGCCTTTGTATCATGCTATTGCTTCCCGTATGGCTTTCATTTTCTCCTCCTTGTATAAATCC<br>TGGTTAGTTCTTGCCACGGCGGAACTCATCGCCGCCTGCCTTGCCCGCTGCTGGACAGGGG<br>CTCGGCTGTTGGGCACTGACAATTCCGTGGCTCGAGAGATCTTCGACTGTGCCTTCTAGTTG<br>CCAGCCATCTGTTGTTTGCCCCTCCCCCGTGCCTTCCTTGACCCTGGAAGGTGCCACTCCCA<br>CTGTCCTTTCCTAATAAAATGAGGAAATTGCATCGCATTGTCTGAGTAGGTGTCATTCTATTCT<br>GGGGGGTGGGGTGGGGCAGGACAGCAAGGGGGAGGATTGGGAAGACAATAGCAGGCATG<br>AGATCTCACGTGCGGACCGAGCGGCCGC (SEQ ID NO: 193) |
| CN2105 (1639)<br>GCGGCCGCACGCGTTCCTCCCTGTCAGTGACATCACTTGAAAAGCCCAACAATGCCCGCAC<br>ACGCTTGGATTTCACGTCTAGAATAGTATCTGTGTAGCCGACCTCCTGGAGATACCTGCACAA<br>AACGGATCCTTATAGTTCAGTCACACAGGAATTAGTGTTGTAAAATTTAAAATGTAAATAAAAA<br>TATTTCTTTAAGCTCACTGACTATATAAGGTTTAAGAGAACAGTGCCATGTCAGTAAGGCTTGT<br>TAATAATATTCCAGCTGCAGATGGAGCTGTCTCTTGCAGTACCGAGCTCGGGCTGGGCATAA<br>AAGTCAGGGCAGAGCCATCTATTGCTTACATTTGCTTCTGGGATCCAGATCTTTCGAAGCTAG<br>CGCTACCGGTCGCCACCATGGTGAGCAAGGGCGAGGAGCTGTTCACCGGGGTGGTGCCCA |

| Fig 26 cont'd |
| --- |
| Vector ID (length between ITRs) & Sequence Between ITRs |
| TCCTGGTCGAGCTGGACGGCGACGTAAACGGCCACAAGTTCAGCGTGTCCGGCGAGGGCG AGGGCGATGCCACCTACGGCAAGCTGACCCTGAAGCTGATCTGCACCACCGGCAAGCTGCC CGTGCCCTGGCCCACCCTCGTGACCACCCTGGGCTACGGCGTGCAGTGCTTCGCCCGCTAC CCCGACCACATGAAGCAGCACGACTTCTTCAAGTCCGCCATGCCCGAAGGCTACGTCCAGG AGCGCACCATCTTCTTCAAGGACGACGGCAACTACAAGACCCGCGCCGAGGTGAAGTTCGA GGGCGACACCCTGGTGAACCGCATCGAGCTGAAGGGCATCGACTTCAAGGAGGACGGCAA CATCCTGGGGCACAAGCTGGAGTACAACTACAACAGCCACAACGTCTATATCACCGCCGACA AGCAGAAGAACGGCATCAAGGCCAACTTCAAGATCCGCCACAACATCGAGGACGGCGGCGT GCAGCTCGCCGACCACTACCAGCAGAACACCCCCATCGGCGACGGCCCCGTGCTGCTGCC CGACAACCACTACCTGAGCTACCAGTCCAAGCTGAGCAAAGACCCCAACGAGAAGCGCGAT CACATGGTCCTGCTGGAGTTCGTGACCGCCGCCGGGATCACTCTCGGCATGGACGAGCTGT ACAAGTAAGTCGACGGCGCGCCGCGGCCGCGAATTCGATATCATAATCAACCTCTGGATTAC AAAATTTGTGAAAGATTGACTGGTATTCTTAACTATGTTGCTCCTTTTACGCTATGTGGATACG CTGCTTTAATGCCTTTGTATCATGCTATTGCTTCCCGTATGGCTTTCATTTTCTCCTCCTTGTA TAAATCCTGGTTAGTTCTTGCCACGGCGGAACTCATCGCCGCCTGCCTTGCCCGCTGCTGGA CAGGGGCTCGGCTGTTGGGCACTGACAATTCCGTGGCTCGAGAGATCTTCGACTGTGCCTT CTAGTTGCCAGCCATCTGTTGTTTGCCCCTCCCCCGTGCCTTCCTTGACCCTGGAAGGTGCC ACTCCCACTGTCCTTTCCTAATAAAATGAGGAAATTGCATCGCATTGTCTGAGTAGGTGTCAT TCTATTCTGGGGGGTGGGGTGGGGCAGGACAGCAAGGGGGAGGATTGGGAAGACAATAGC AGGCATGAGATCTCACGTGCGGACCGAGCGGCCGC (SEQ ID NO: 194) |
| CN2106 (1776)<br>GCGGCCGCACGCGTTGGTGCGACAGAAATATGGCTAAAGCTAGTTTTGTTTTAAATAGAACA TGGATTTCTATGAAAGAATTATATTGATAAATTATTAGTAGCAAGTTAAGATAAATTGTTAACAT TTGTCTACTTTATGCACTAGGCACAAATACTTATTAATGAAACCCCTCATGTGTGAAGATTATT TATTTATGTTTCTCAAACAAAAATGGTATTGTATCCGATTCACTGGGTGTGCTTTGTCCAGTCT GATTTTCTCATTAGCAATTCTCTGCATGATTAAATGCTAAATACACAGCTGTGTAAAGCCTCAA CTGGTAGTAACCAGTAGTGCCTAATACTGCTGTCTTAAAGGAATAACAATATAGTCAAATACT GGATGTACAAGCTTTAAGGCCCCATTCAGCTGAAAGACCTGGGGTTATCAGAGCTCGGGCTG GGCATAAAAGTCAGGGCAGAGCCATCTATTGCTTACATTTGCTTCTGGGATCCAGATCTTTCG AAGCTAGCGCTACCGGTCGCCACCATGGTGAGCAAGGGCGAGGAGCTGTTCACCGGGGTG GTGCCCATCCTGGTCGAGCTGGACGGCGACGTAAACGGCCACAAGTTCAGCGTGTCCGGCG AGGGCGAGGGCGATGCCACCTACGGCAAGCTGACCCTGAAGCTGATCTGCACCACCGGCAA GCTGCCCGTGCCCTGGCCCACCCTCGTGACCACCCTGGGCTACGGCGTGCAGTGCTTCGC CCGCTACCCCGACCACATGAAGCAGCACGACTTCTTCAAGTCCGCCATGCCCGAAGGCTAC GTCCAGGAGCGCACCATCTTCTTCAAGGACGACGGCAACTACAAGACCCGCGCCGAGGTGA AGTTCGAGGGCGACACCCTGGTGAACCGCATCGAGCTGAAGGGCATCGACTTCAAGGAGGA CGGCAACATCCTGGGGCACAAGCTGGAGTACAACTACAACAGCCACAACGTCTATATCACCG CCGACAAGCAGAAGAACGGCATCAAGGCCAACTTCAAGATCCGCCACAACATCGAGGACGG CGGCGTGCAGCTCGCCGACCACTACCAGCAGAACACCCCCATCGGCGACGGCCCCGTGCT GCTGCCCGACAACCACTACCTGAGCTACCAGTCCAAGCTGAGCAAAGACCCCAACGAGAAG CGCGATCACATGGTCCTGCTGGAGTTCGTGACCGCCGCCGGGATCACTCTCGGCATGGACG AGCTGTACAAGTAAGTCGACGGCGCGCCGCGGCCGCGAATTCGATATCATAATCAACCTCTG GATTACAAAATTTGTGAAAGATTGACTGGTATTCTTAACTATGTTGCTCCTTTTACGCTATGTG GATACGCTGCTTTAATGCCTTTGTATCATGCTATTGCTTCCCGTATGGCTTTCATTTTCTCCTC CTTGTATAAATCCTGGTTAGTTCTTGCCACGGCGGAACTCATCGCCGCCTGCCTTGCCCGCT GCTGGACAGGGGCTCGGCTGTTGGGCACTGACAATTCCGTGGCTCGAGAGATCTTCGACTG TGCCTTCTAGTTGCCAGCCATCTGTTGTTTGCCCCTCCCCCGTGCCTTCCTTGACCCTGGAA GGTGCCACTCCCACTGTCCTTTCCTAATAAAATGAGGAAATTGCATCGCATTGTCTGAGTAGG |

| Fig 26 cont'd |
|---|
| Vector ID (length between ITRs) & Sequence Between ITRs |
| TGTCATTCTATTCTGGGGGGTGGGGTGGGGCAGGACAGCAAGGGGGAGGATTGGGAAGAC AATAGCAGGCATGAGATCTCACGTGCGGACCGAGCGGCCGC (SEQ ID NO: 195) |
| CN2107 (1719)<br>GCGGCCGCACGCGTTCCTCTGTGCAACCCTCTGCTCTGTCTGGTGTGATACACAGAGGTTCT ACACAACTGGGCTATGATGGGACAAAACAAGGCTCCACTCATAGCAACTGCCTGCCCGCTCT GTGCATAAAGAAAGGGTTCTCTGTGTTGTAGCATTCTTGCCTGTCAGCTGCTCAACAAACAGA TGTTCATGTTCTGCTCAGAGTTCTGGCTACCCCAGGTCCAGGCAAGGCACAGAGTAGTGGG GATAACTGCAGAGGAAGGGAGAAGGGGTGAGTTGGGCTTCCCATACTGCACACTTTTCCTTC CCCTGATGCTGTTTGAGAGTGAGCCTCACAGTTTCACCTCCAGCAGCCCAGTGCAGCCAAGT TTAGAGCTCGGGCTGGGCATAAAAGTCAGGGCAGAGCCATCTATTGCTTACATTTGCTTCTG GGATCCAGATCTTTCGAAGCTAGCGCTACCGGTCGCCACCATGGTGAGCAAGGGCGAGGAG CTGTTCACCGGGGTGGTGCCCATCCTGGTCGAGCTGGACGGCGACGTAAACGGCCACAAGT TCAGCGTGTCCGGCGAGGGCGAGGGCGATGCCACCTACGGCAAGCTGACCCTGAAGCTGA TCTGCACCACCGGCAAGCTGCCCGTGCCCTGGCCCACCCTCGTGACCACCCTGGGCTACGG CGTGCAGTGCTTCGCCCGCTACCCCGACCACATGAAGCAGCACGACTTCTTCAAGTCCGCC ATGCCCGAAGGCTACGTCCAGGAGCGCACCATCTTCTTCAAGGACGACGGCAACTACAAGA CCCGCGCCGAGGTGAAGTTCGAGGGCGACACCCTGGTGAACCGCATCGAGCTGAAGGGCA TCGACTTCAAGGAGGACGGCAACATCCTGGGGCACAAGCTGGAGTACAACTACAACAGCCA CAACGTCTATATCACCGCCGACAAGCAGAAGAACGGCATCAAGGCCAACTTCAAGATCCGCC ACAACATCGAGGACGGCGGCGTGCAGCTCGCCGACCACTACCAGCAGAACACCCCCATCGG CGACGGCCCCGTGCTGCTGCCCGACAACCACTACCTGAGCTACCAGTCCAAGCTGAGCAAA GACCCCAACGAGAAGCGCGATCACATGGTCCTGCTGGAGTTCGTGACCGCCGCCGGGATCA CTCTCGGCATGGACGAGCTGTACAAGTAAGTCGACGGCGCGCCGCGGCCGCGAATTCGATA TCATAATCAACCTCTGGATTACAAAATTTGTGAAAGATTGACTGGTATTCTTAACTATGTTGCT CCTTTTACGCTATGTGGATACGCTGCTTTAATGCCTTTGTATCATGCTATTGCTTCCCGTATGG CTTTCATTTTCTCCTCCTTGTATAAATCCTGGTTAGTTCTTGCCACGGCGGAACTCATCGCCG CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCGC (SEQ ID NO: 196) |
| CN2108 (1678)<br>GCGGCCGCACGCGTGGGAGTCCCAAATGTATTCAATCCTGACACTTAAAGAGAAATGTGGCT TCGTTTCTAAAGAGCCATTCTCAATCCTATAGAGCTGCTTTCTAGTAGATGGAATACACAAGC ATCTGCCTGTGTCTGGTAGAAGCCTAGAAAGTAGACAATGGTTCTATTCAGGCCAAGCACTTC CCCTCCAACAGGCATCTAAGCAGCACTGTGTTAGGGAGATGACTCTGACATGCCCTGAATAG ATGACCGGTTTGGAGCACCTGCCCTGTGGACTGTGACAGCACAAGCCAGGGATACTGAATCT TCTGGCCTATGTCTACTGCTCTGAGCTCGGGCTGGGCATAAAAGTCAGGGCAGAGCCATCTA TTGCTTACATTTGCTTCTGGGATCCAGATCTTTCGAAGCTAGCGCTACCGGTCGCCACCATG GTGAGCAAGGGCGAGGAGCTGTTCACCGGGGTGGTGCCCATCCTGGTCGAGCTGGACGGC GACGTAAACGGCCACAAGTTCAGCGTGTCCGGCGAGGGCGAGGGCGATGCCACCTACGGC AAGCTGACCCTGAAGCTGATCTGCACCACCGGCAAGCTGCCCGTGCCCTGGCCCACCCTCG TGACCACCCTGGGCTACGGCGTGCAGTGCTTCGCCCGCTACCCCGACCACATGAAGCAGCA CGACTTCTTCAAGTCCGCCATGCCCGAAGGCTACGTCCAGGAGCGCACCATCTTCTTCAAGG ACGACGGCAACTACAAGACCCGCGCCGAGGTGAAGTTCGAGGGCGACACCCTGGTGAACC GCATCGAGCTGAAGGGCATCGACTTCAAGGAGGACGGCAACATCCTGGGGCACAAGCTGGA GTACAACTACAACAGCCACAACGTCTATATCACCGCCGACAAGCAGAAGAACGGCATCAAGG CCAACTTCAAGATCCGCCACAACATCGAGGACGGCGGCGTGCAGCTCGCCGACCACTACCA |

| Fig 26 cont'd |
| --- |
| Vector ID (length between ITRs) & Sequence Between ITRs |
| GCAGAACACCCCCATCGGCGACGGCCCCGTGCTGCTGCCCGACAACCACTACCTGAGCTAC CAGTCCAAGCTGAGCAAAGACCCCAACGAGAAGCGCGATCACATGGTCCTGCTGGAGTTCG TGACCGCCGCCGGGATCACTCTCGGCATGGACGAGCTGTACAAGTAAGTCGACGGCGCGCC GCGGCCGCGAATTCGATATCATAATCAACCTCTGGATTACAAAATTTGTGAAAGATTGACTGG TATTCTTAACTATGTTGCTCCTTTTACGCTATGTGGATACGCTGCTTTAATGCCTTTGTATCAT GCTATTGCTTCCCGTATGGCTTTCATTTTCTCCTCCTTGTATAAATCCTGGTTAGTTCTTGCCA CGGCGGAACTCATCGCCGCCTGCCTTGCCCGCTGCTGGACAGGGGCTCGGCTGTTGGGCA CTGACAATTCCGTGGCTCGAGAGATCTTCGACTGTGCCTTCTAGTTGCCAGCCATCTGTTGTT TGCCCCTCCCCCGTGCCTTCCTTGACCCTGGAAGGTGCCACTCCCACTGTCCTTTCCTAATA AAATGAGGAAATTGCATCGCATTGTCTGAGTAGGTGTCATTCTATTCTGGGGGGTGGGGTGG GGCAGGACAGCAAGGGGGAGGATTGGGAAGACAATAGCAGGCATGAGATCTCACGTGCGG ACCGAGCGGCCGC (SEQ ID NO: 197) |
| CN2109 (1653) GCGGCCGCACGCGTGCACTCCAGATAGAAAGGCCCATTGTTTTCTGCATCTGAAGTTAACAC TCTTCCCTTTATTCTTTCTTCCAGGCCTTTTAGTGTTTGCTTAATCAGAATATTTTAATCTCTAA TGTGGTGACTAGATGTAATTTATCACATTAAGCCTCTCCTATTTTCTTCTGCTTACATGACTAA CGTTATTGTGTTTTTATTGCGCTTATACAAACAAGCCTTTCCTTTGTTCCATTGTTTCAGCAATA GGTCAAAAATCAACAAATAAAGCTTTATCTTTCCAATCCTGGACTCACCCACTGAGCTCGGGC TGGGCATAAAAGTCAGGGCAGAGCCATCTATTGCTTACATTTGCTTCTGGGATCCAGATCTTT CGAAGCTAGCGCTACCGGTCGCCACCATGGTGAGCAAGGGCGAGGAGCTGTTCACCGGGG TGGTGCCCATCCTGGTCGAGCTGGACGGCGACGTAAACGGCCACAAGTTCAGCGTGTCCGG CGAGGGCGAGGGCGATGCCACCTACGGCAAGCTGACCCTGAAGCTGATCTGCACCACCGG CAAGCTGCCCGTGCCCTGGCCCACCCTCGTGACCACCCTGGGCTACGGCGTGCAGTGCTTC GCCCGCTACCCCGACCACATGAAGCAGCACGACTTCTTCAAGTCCGCCATGCCCGAAGGCT ACGTCCAGGAGCGCACCATCTTCTTCAAGGACGACGGCAACTACAAGACCCGCGCCGAGGT GAAGTTCGAGGGCGACACCCTGGTGAACCGCATCGAGCTGAAGGGCATCGACTTCAAGGAG GACGGCAACATCCTGGGGCACAAGCTGGAGTACAACTACAACAGCCACAACGTCTATATCAC CGCCGACAAGCAGAAGAACGGCATCAAGGCCAACTTCAAGATCCGCCACAACATCGAGGAC GGCGGCGTGCAGCTCGCCGACCACTACCAGCAGAACACCCCCATCGGCGACGGCCCCGTG CTGCTGCCCGACAACCACTACCTGAGCTACCAGTCCAAGCTGAGCAAAGACCCCAACGAGA AGCGCGATCACATGGTCCTGCTGGAGTTCGTGACCGCCGCCGGGATCACTCTCGGCATGGA CGAGCTGTACAAGTAAGTCGACGGCGCGCCGCGGCCGCGAATTCGATATCATAATCAACCT CTGGATTACAAAATTTGTGAAAGATTGACTGGTATTCTTAACTATGTTGCTCCTTTTACGCTAT GTGGATACGCTGCTTTAATGCCTTTGTATCATGCTATTGCTTCCCGTATGGCTTTCATTTTCTC CTCCTTGTATAAATCCTGGTTAGTTCTTGCCACGGCGGAACTCATCGCCGCCTGCCTTGCCC GCTGCTGGACAGGGGCTCGGCTGTTGGGCACTGACAATTCCGTGGCTCGAGAGATCTTCGA CTGTGCCTTCTAGTTGCCAGCCATCTGTTGTTTGCCCCTCCCCCGTGCCTTCCTTGACCCTG GAAGGTGCCACTCCCACTGTCCTTTCCTAATAAAATGAGGAAATTGCATCGCATTGTCTGAGT AGGTGTCATTCTATTCTGGGGGGTGGGGTGGGGCAGGACAGCAAGGGGGAGGATTGGGAA GACAATAGCAGGCATGAGATCTCACGTGCGGACCGAGCGGCCGC (SEQ ID NO: 198) |
| CN2110 (1707) GCGGCCGCACGCGTGGACTGAGAGCCCCAGTTCCTAGACGCCCCCCAGCCACAAAACGGG GGGCCCGGTTGGAGTGGAGTTTCTAAGAATAAAGCCACTTCCAGAGCGGGCAGAGATCAGG GACTTTCAGGCCAGCTCCATCCAAGGGTGAGCTCAGGCAGGCCCGGCTGGCCGGGATGGG AAGGGCTGACCACTTCCTGCTCAGGGCTGGCGGTCCCCGCAGTCATCAGAAGCCAACCAC TTCCCGGTCTGGGCCGCCTTCCCCTTTCTAGCCAAGCGGGAGGGTAGAGGATGAGGTGGCC CTTTGCGTGCTGTGGCCTGGGCGACTCTGGCCTCTTTTCATTTCCCCACTATCGCTGCGTGA GCTCGGGCTGGGCATAAAAGTCAGGGCAGAGCCATCTATTGCTTACATTTGCTTCTGGGATC CAGATCTTTCGAAGCTAGCGCTACCGGTCGCCACCATGGTGAGCAAGGGCGAGGAGCTGTT |

| Fig 26 cont'd |
| --- |
| Vector ID (length between ITRs) & Sequence Between ITRs |
| CACCGGGGTGGTGCCCATCCTGGTCGAGCTGGACGGCGACGTAAACGGCCACAAGTTCAG CGTGTCCGGCGAGGGCGAGGGCGATGCCACCTACGGCAAGCTGACCCTGAAGCTGATCTG CACCACCGGCAAGCTGCCCGTGCCCTGGCCCACCCTCGTGACCACCCTGGGCTACGGCGT GCAGTGCTTCGCCCGCTACCCCGACCACATGAAGCAGCACGACTTCTTCAAGTCCGCCATG CCCGAAGGCTACGTCCAGGAGCGCACCATCTTCTTCAAGGACGACGGCAACTACAAGACCC GCGCCGAGGTGAAGTTCGAGGGCGACACCCTGGTGAACCGCATCGAGCTGAAGGGCATCG ACTTCAAGGAGGACGGCAACATCCTGGGGCACAAGCTGGAGTACAACTACAACAGCCACAA CGTCTATATCACCGCCGACAAGCAGAAGAACGGCATCAAGGCCAACTTCAAGATCCGCCACA ACATCGAGGACGGCGGCGTGCAGCTCGCCGACCACTACCAGCAGAACACCCCCATCGGCG ACGGCCCCGTGCTGCTGCCCGACAACCACTACCTGAGCTACCAGTCCAAGCTGAGCAAAGA CCCCAACGAGAAGCGCGATCACATGGTCCTGCTGGAGTTCGTGACCGCCGCCGGGATCACT CTCGGCATGGACGAGCTGTACAAGTAAGTCGACGGCGCGCCGCGGCCGCGAATTCGATATC ATAATCAACCTCTGGATTACAAAATTTGTGAAAGATTGACTGGTATTCTTAACTATGTTGCTCC TTTTACGCTATGTGGATACGCTGCTTTAATGCCTTTGTATCATGCTATTGCTTCCCGTATGGCT TTCATTTTCTCCTCCTTGTATAAATCCTGGTTAGTTCTTGCCACGGCGGAACTCATCGCCGCC TGCCTTGCCCGCTGCTGGACAGGGGCTCGGCTGTTGGGCACTGACAATTCCGTGGCTCGAG AGATCTTCGACTGTGCCTTCTAGTTGCCAGCCATCTGTTGTTTGCCCCTCCCCCGTGCCTTCC TTGACCCTGGAAGGTGCCACTCCCACTGTCCTTTCCTAATAAAATGAGGAAATTGCATCGCAT TGTCTGAGTAGGTGTCATTCTATTCTGGGGGGTGGGGTGGGGCAGGACAGCAAGGGGGAG GATTGGGAAGACAATAGCAGGCATGAGATCTCACGTGCGGACCGAGCGGCCGC (SEQ ID NO: 199) |
| CN2111 (1658) GCGGCCGCACGCGTACTGAGAAAAATGATTGGGCCNCTNTTTTTTTTTTTTTTTTTTTTACAGA GAGCTAATCTTGAAATCAGAATCTGTAGGTAGTGGACCTTCAATGATCACTGTTTCAAATCGA GATGTGACTTTAAAAAAAAAAAAAAAAAAAAAAAAGGAATTCCAGACAGCTGACTGTGGCCAACA GCAGCTGTGTCACATGCTGGTCTGAGGAAGTGGTCAGAGGGCAAGCAACTCTATATTGCATT TTCTTTGCAGAATGGAGCCCTCTGCAGCTGAGTGAACCCAGGGGCTGGACGTGCTCACCCT ATGAGCTCGGGCTGGGCATAAAAGTCAGGGCAGAGCCATCTATTGCTTACATTTGCTTCTGG GATCCAGATCTTTCGAAGCTAGCGCTACCGGTCGCCACCATGGTGAGCAAGGGCGAGGAGC TGTTCACCGGGGTGGTGCCCATCCTGGTCGAGCTGGACGGCGACGTAAACGGCCACAAGTT CAGCGTGTCCGGCGAGGGCGAGGGCGATGCCACCTACGGCAAGCTGACCCTGAAGCTGAT CTGCACCACCGGCAAGCTGCCCGTGCCCTGGCCCACCCTCGTGACCACCCTGGGCTACGG CGTGCAGTGCTTCGCCCGCTACCCCGACCACATGAAGCAGCACGACTTCTTCAAGTCCGCC ATGCCCGAAGGCTACGTCCAGGAGCGCACCATCTTCTTCAAGGACGACGGCAACTACAAGA CCCGCGCCGAGGTGAAGTTCGAGGGCGACACCCTGGTGAACCGCATCGAGCTGAAGGGCA TCGACTTCAAGGAGGACGGCAACATCCTGGGGCACAAGCTGGAGTACAACTACAACAGCCA CAACGTCTATATCACCGCCGACAAGCAGAAGAACGGCATCAAGGCCAACTTCAAGATCCGCC ACAACATCGAGGACGGCGGCGTGCAGCTCGCCGACCACTACCAGCAGAACACCCCCATCGG CGACGGCCCCGTGCTGCTGCCCGACAACCACTACCTGAGCTACCAGTCCAAGCTGAGCAAA GACCCCAACGAGAAGCGCGATCACATGGTCCTGCTGGAGTTCGTGACCGCCGCCGGGATCA CTCTCGGCATGGACGAGCTGTACAAGTAAGTCGACGGCGCGCCGCGGCCGCGAATTCGATA TCATAATCAACCTCTGGATTACAAAATTTGTGAAAGATTGACTGGTATTCTTAACTATGTTGCT CCTTTTACGCTATGTGGATACGCTGCTTTAATGCCTTTGTATCATGCTATTGCTTCCCGTATGG CTTTCATTTTCTCCTCCTTGTATAAATCCTGGTTAGTTCTTGCCACGGCGGAACTCATCGCCG CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA |

| Fig 26 cont'd |
| --- |
| Vector ID (length between ITRs) & Sequence Between ITRs |
| GGATTGGGAAGACAATAGCAGGCATGAGATCTCACGTGCGGACCGAGCGGCCGC (SEQ ID NO: 200) |
| CN2112 (1728)<br>GCGGCCGCACGCGTAGCTCTCTGTCCTAGCACAGTGCATGACAACAAACAGGCAAAGAAGA<br>TGTTGAAAAAGATGCACACAGAATGGATGAAAGTTTGCAAAGCTCTCTCTCTCCCTCCGAGTT<br>TTTCTTTTTTTCTTTTTCCAAGATCTTCCAGAAAAAAAAAGCAGAACCTTTGACCAGACAGAGC<br>AAACATGTCACAGAGTTCTGCTTTCACCGTATGTTAAGTGGAAATGATTGGGCAAGTGAGTTG<br>TAAGCGATTCCTCTCCGAGTTTCCTCTGAGCTGGGGGGTTGATCCTGCGCACTCAGACTGACA<br>GTGCAAAGTGTGAAGGCTTGCGCTCAGCACTCTCAAGTCCCACCGTGCCTCAGCTACCTTCC<br>ATCGTGGGCGAGCTCGGGCTGGGCATAAAAGTCAGGGCAGAGCCATCTATTGCTTACATTTG<br>CTTCTGGGATCCAGATCTTTCGAAGCTAGCGCTACCGGTCGCCACCATGGTGAGCAAGGGC<br>GAGGAGCTGTTCACCGGGGTGGTGCCCATCCTGGTCGAGCTGGACGGCGACGTAAACGGC<br>CACAAGTTCAGCGTGTCCGGCGAGGGCGAGGGCGATGCCACCTACGGCAAGCTGACCCTG<br>AAGCTGATCTGCACCACCGGCAAGCTGCCCGTGCCCTGGCCCACCCTCGTGACCACCCTGG<br>GCTACGGCGTGCAGTGCTTCGCCCGCTACCCCGACCACATGAAGCAGCACGACTTCTTCAA<br>GTCCGCCATGCCCGAAGGCTACGTCCAGGAGCGCACCATCTTCTTCAAGGACGACGGCAAC<br>TACAAGACCCGCGCCGAGGTGAAGTTCGAGGGCGACACCCTGGTGAACCGCATCGAGCTGA<br>AGGGCATCGACTTCAAGGAGGACGGCAACATCCTGGGGCACAAGCTGGAGTACAACTACAA<br>CAGCCACAACGTCTATATCACCGCCGACAAGCAGAAGAACGGCATCAAGGCCAACTTCAAGA<br>TCCGCCACAACATCGAGGACGGCGGCGTGCAGCTCGCCGACCACTACCAGCAGAACACCCC<br>CATCGGCGACGGCCCCGTGCTGCTGCCCGACAACCACTACCTGAGCTACCAGTCCAAGCTG<br>AGCAAAGACCCCAACGAGAAGCGCGATCACATGGTCCTGCTGGAGTTCGTGACCGCCGCCG<br>GGATCACTCTCGGCATGGACGAGCTGTACAAGTAAGTCGACGGCGCGCCGCGGCCGCGAAT<br>TCGATATCATAATCAACCTCTGGATTACAAAATTTGTGAAAGATTGACTGGTATTCTTAACTAT<br>GTTGCTCCTTTTACGCTATGTGGATACGCTGCTTTAATGCCTTTGTATCATGCTATTGCTTCCC<br>GTATGGCTTTCATTTTCTCCTCCTTGTATAAATCCTGGTTAGTTCTTGCCACGGCGGAACTCAT<br>CGCCGCCTGCCTTGCCCGCTGCTGGACAGGGGCTCGGCTGTTGGGCACTGACAATTCCGTG<br>GCTCGAGAGATCTTCGACTGTGCCTTCTAGTTGCCAGCCATCTGTTGTTTGCCCCTCCCCCG<br>TGCCTTCCTTGACCCTGGAAGGTGCCACTCCCACTGTCCTTTCCTAATAAAATGAGGAAATTG<br>CATCGCATTGTCTGAGTAGGTGTCATTCTATTCTGGGGGGTGGGGTGGGGCAGGACAGCAA<br>GGGGGAGGATTGGGAAGACAATAGCAGGCATGAGATCTCACGTGCGGACCGAGCGGCCGC<br>(SEQ ID NO: 201) |
| CN2113 (1842)<br>GCGGCCGCACGCGTCAGGAACCTGGTGACATGGGAACCAGGGCCCAAAAGATATGGGGGTG<br>GGGCAGTTCCCTAACCAGTCTGTCACGCTAGCCTTTCCACTGGCAGCCGGGCCTGGTTTGTA<br>GTTCCATCCAGCACTTGTCCAGGCCCACAGGCTGGGGCCTCCCCTCCCTCCCCAAAGCCCC<br>CTCCCCAGGGCCTGTTTCCCGGAGGAGCTGGGGTCTTCCCCAGAATCCATGATTCACTCAAG<br>CTGGGGCCTTTTCACTTCTGCTTTGGAGCTAAAAATATAGAGACCAAGGAGTCTTGTTGAGCA<br>GGCCTCCCCACACATTGCACAATATCCCCCCTCGGCCCCTCCCCAGAACAGCTAGAGAGCT<br>CTGCTGACGCAGGGTCCAATGTGGACCCAAACTTCTCCTAGGTTGTCTGTGCTGAGGTCAGG<br>GCTTACGTTCACGCGCTGCTTTTGTGAGCCAGAAAGTCCCTTCCTGTAGCCCTAGTAACCCA<br>GGCATGAGCTCGGGCTGGGCATAAAAGTCAGGGCAGAGCCATCTATTGCTTACATTTGCTTC<br>TGGGATCCAGATCTTTCGAAGCTAGCGCTACCGGTCGCCACCATGGTGAGCAAGGGCGAGG<br>AGCTGTTCACCGGGGTGGTGCCCATCCTGGTCGAGCTGGACGGCGACGTAAACGGCCACAA<br>GTTCAGCGTGTCCGGCGAGGGCGAGGGCGATGCCACCTACGGCAAGCTGACCCTGAAGCT<br>GATCTGCACCACCGGCAAGCTGCCCGTGCCCTGGCCCACCCTCGTGACCACCCTGGGCTAC<br>GGCGTGCAGTGCTTCGCCCGCTACCCCGACCACATGAAGCAGCACGACTTCTTCAAGTCCG<br>CCATGCCCGAAGGCTACGTCCAGGAGCGCACCATCTTCTTCAAGGACGACGGCAACTACAA<br>GACCCGCGCCGAGGTGAAGTTCGAGGGCGACACCCTGGTGAACCGCATCGAGCTGAAGGG |

| Fig 26 cont'd |
| --- |
| Vector ID (length between ITRs) & Sequence Between ITRs |
| CATCGACTTCAAGGAGGACGGCAACATCCTGGGGCACAAGCTGGAGTACAACTACAACAGC CACAACGTCTATATCACCGCCGACAAGCAGAAGAACGGCATCAAGGCCAACTTCAAGATCCG CCACAACATCGAGGACGGCGGCGTGCAGCTCGCCGACCACTACCAGCAGAACACCCCCATC GGCGACGGCCCCGTGCTGCTGCCCGACAACCACTACCTGAGCTACCAGTCCAAGCTGAGCA AAGACCCCAACGAGAAGCGCGATCACATGGTCCTGCTGGAGTTCGTGACCGCCGCCGGGAT CACTCTCGGCATGGACGAGCTGTACAAGTAAGTCGACGGCGCGCCGCGGCCGCGAATTCGA TATCATAATCAACCTCTGGATTACAAAATTTGTGAAAGATTGACTGGTATTCTTAACTATGTTG CTCCTTTTACGCTATGTGGATACGCTGCTTTAATGCCTTTGTATCATGCTATTGCTTCCCGTAT GGCTTTCATTTTCTCCTCCTTGTATAAATCCTGGTTAGTTCTTGCCACGGCGGAACTCATCGC CGCCTGCCTTGCCCGCTGCTGGACAGGGGCTCGGCTGTTGGGCACTGACAATTCCGTGGCT CGAGAGATCTTCGACTGTGCCTTCTAGTTGCCAGCCATCTGTTGTTTGCCCCTCCCCCGTGC CTTCCTTGACCCTGGAAGGTGCCACTCCCACTGTCCTTTCCTAATAAAATGAGGAAATTGCAT CGCATTGTCTGAGTAGGTGTCATTCTATTCTGGGGGGTGGGGTGGGGCAGGACAGCAAGGG GGAGGATTGGGAAGACAATAGCAGGCATGAGATCTCACGTGCGGACCGAGCGGCCGC (SEQ ID NO: 202) |
| CN2114 (1773) GCGGCCGCACGCGTAGCCCAGACTTTGCCTTCCTCCCAGGATCCCCGAGGCCTCACCCTTC CTGTGCGAACTTGCAGACTTCCCTAACTGCCACTAGGGACCACAACTGCCTGACTCACAACC AACAGGAAGCAGGCTGTGAGGGGCCAGGTGAAATGAAGTCAAAGACACAGGAAATGCTCTG AGCCAGATTTCTATCATTGCCCCAGGTGATGTCCTTTGCCTGAGTTAGCTAACTATACAACCC AGCATCCTCCCCAGGTCGAGGCAGAGCTCAGATACCATCTGTCCCAATCTCTCACCCAAATA ATAAATTCTGAAGGAAACATTCCTGCAGCTCAGCCAGGCAACTTCTGCCTGTTTGTAGAAGCC CTTGAGAAACATGTGGACAGACTCACTCCTCTCTTGTGCAAGCTACACTGCCTTGGGGAGCT CGGGCTGGGCATAAAAGTCAGGGCAGAGCCATCTATTGCTTACATTTGCTTCTGGGATCCAG ATCTTTCGAAGCTAGCGCTACCGGTCGCCACCATGGTGAGCAAGGGCGAGGAGCTGTTCAC CGGGGTGGTGCCCATCCTGGTCGAGCTGGACGGCGACGTAAACGGCCACAAGTTCAGCGT GTCCGGCGAGGGCGAGGGCGATGCCACCTACGGCAAGCTGACCCTGAAGCTGATCTGCAC CACCGGCAAGCTGCCCGTGCCCTGGCCCACCCTCGTGACCACCCTGGGCTACGGCGTGCA GTGCTTCGCCCGCTACCCCGACCACATGAAGCAGCACGACTTCTTCAAGTCCGCCATGCCC GAAGGCTACGTCCAGGAGCGCACCATCTTCTTCAAGGACGACGGCAACTACAAGACCCGCG CCGAGGTGAAGTTCGAGGGCGACACCCTGGTGAACCGCATCGAGCTGAAGGGCATCGACTT CAAGGAGGACGGCAACATCCTGGGGCACAAGCTGGAGTACAACTACAACAGCCACAACGTC TATATCACCGCCGACAAGCAGAAGAACGGCATCAAGGCCAACTTCAAGATCCGCCACAACAT CGAGGACGGCGGCGTGCAGCTCGCCGACCACTACCAGCAGAACACCCCCATCGGCGACGG CCCCGTGCTGCTGCCCGACAACCACTACCTGAGCTACCAGTCCAAGCTGAGCAAAGACCCC AACGAGAAGCGCGATCACATGGTCCTGCTGGAGTTCGTGACCGCCGCCGGGATCACTCTCG GCATGGACGAGCTGTACAAGTAAGTCGACGGCGCGCCGCGGCCGCGAATTCGATATCATAA TCAACCTCTGGATTACAAAATTTGTGAAAGATTGACTGGTATTCTTAACTATGTTGCTCCTTTT ACGCTATGTGGATACGCTGCTTTAATGCCTTTGTATCATGCTATTGCTTCCCGTATGGCTTTC ATTTTCTCCTCCTTGTATAAATCCTGGTTAGTTCTTGCCACGGCGGAACTCATCGCCGCCTGC CTTGCCCGCTGCTGGACAGGGGCTCGGCTGTTGGGCACTGACAATTCCGTGGCTCGAGAGA TCTTCGACTGTGCCTTCTAGTTGCCAGCCATCTGTTGTTTGCCCCTCCCCCGTGCCTTCCTTG ACCCTGGAAGGTGCCACTCCCACTGTCCTTTCCTAATAAAATGAGGAAATTGCATCGCATTGT CTGAGTAGGTGTCATTCTATTCTGGGGGGTGGGGTGGGGCAGGACAGCAAGGGGGAGGATT GGGAAGACAATAGCAGGCATGAGATCTCACGTGCGGACCGAGCGGCCGC (SEQ ID NO: 203) |
| CN2115 (1735) GCGGCCGCACGCGTACAGGGTCCCACAAGCCAAACTGACCATTCTCATCAGCGCAGAAGAA CTAACATGTGACCACCATGGGAGGTACCCCATCTCTAATACCAGTTAATCAGAGTAGAAACAT TTTTCACCTTGGCCATTAAGGCAGATATTTTGATCATTCTGTTCTTAGTCACAAACCTCATTAC |

| Fig 26 cont'd |
| --- |
| Vector ID (length between ITRs) & Sequence Between ITRs |
| ATTTACAGTAATAGAAGAAGAAAAGAGAGAACCAAGGGAAAGCCCTACTCTTCTATCAGGTTT<br>CCCCGTAAACGTCACTTCTCTCAGGAAGCCAGTCAGACAGATCTACCCCAACCGACTTCCCC<br>TGGCTCAGCTCTTCTCACTCATTACATTATCCCTTCCAGAATGATCTTTACCCTCTAGTCCCCA<br>ACACATTCCCCAGCGAGCTCGGGCTGGGCATAAAAGTCAGGGCAGAGCCATCTATTGCTTAC<br>ATTTGCTTCTGGGATCCAGATCTTTCGAAGCTAGCGCTACCGGTCGCCACCATGGTGAGCAA<br>GGGCGAGGAGCTGTTCACCGGGGTGGTGCCCATCCTGGTCGAGCTGGACGGCGACGTAAA<br>CGGCCACAAGTTCAGCGTGTCCGGCGAGGGCGAGGGCGATGCCACCTACGGCAAGCTGAC<br>CCTGAAGCTGATCTGCACCACCGGCAAGCTGCCCGTGCCCTGGCCCACCCTCGTGACCACC<br>CTGGGCTACGGCGTGCAGTGCTTCGCCCGCTACCCCGACCACATGAAGCAGCACGACTTCT<br>TCAAGTCCGCCATGCCCGAAGGCTACGTCCAGGAGCGCACCATCTTCTTCAAGGACGACGG<br>CAACTACAAGACCCGCGCCGAGGTGAAGTTCGAGGGCGACACCCTGGTGAACCGCATCGAG<br>CTGAAGGGCATCGACTTCAAGGAGGACGGCAACATCCTGGGGCACAAGCTGGAGTACAACT<br>ACAACAGCCACAACGTCTATATCACCGCCGACAAGCAGAAGAACGGCATCAAGGCCAACTTC<br>AAGATCCGCCACAACATCGAGGACGGCGGCGTGCAGCTCGCCGACCACTACCAGCAGAACA<br>CCCCCATCGGCGACGGCCCCGTGCTGCTGCCCGACAACCACTACCTGAGCTACCAGTCCAA<br>GCTGAGCAAAGACCCCAACGAGAAGCGCGATCACATGGTCCTGCTGGAGTTCGTGACCGCC<br>GCCGGGATCACTCTCGGCATGGACGAGCTGTACAAGTAAGTCGACGGCGCGCCGCGGCCG<br>CGAATTCGATATCATAATCAACCTCTGGATTACAAAATTTGTGAAAGATTGACTGGTATTCTTA<br>ACTATGTTGCTCCTTTTACGCTATGTGGATACGCTGCTTTAATGCCTTTGTATCATGCTATTGC<br>TTCCCGTATGGCTTTCATTTTCTCCTCCTTGTATAAATCCTGGTTAGTTCTTGCCACGGCGGA<br>ACTCATCGCCGCCTGCCTTGCCCGCTGCTGGACAGGGGCTCGGCTGTTGGGCACTGACAAT<br>TCCGTGGCTCGAGAGATCTTCGACTGTGCCTTCTAGTTGCCAGCCATCTGTTGTTTGCCCCT<br>CCCCCGTGCCTTCCTTGACCCTGGAAGGTGCCACTCCCACTGTCCTTTCCTAATAAAATGAG<br>GAAATTGCATCGCATTGTCTGAGTAGGTGTCATTCTATTCTGGGGGGTGGGGTGGGGCAGG<br>ACAGCAAGGGGGAGGATTGGGAAGACAATAGCAGGCATGAGATCTCACGTGCGGACCGAGC<br>GGCCGC (SEQ ID NO: 204) |
| CN2116 (1655)<br>GCGGCCGCACGCGTACCTGGATCCCCCGTGTTTCTGTGGCCTGGCCTCCTGGTTCTGGGGC<br>TGGGCAGGGAGGTAGGGAGGACCTGCCCATTGTTCCCATGTGCCAGGTGAGTCAACGCCAT<br>GTTCCCAGCTGCACCCACTCCATTCCTCTACCCTGACCTTAGGAAAGGAAGACCAAGCAGTC<br>TTGTAAAACATTTGCTCAATCCCTCAGCCACAGAGCTTACTACACAACTGCCTGCGTGGCTTC<br>TTTGGCCATAACGCTTCTGTGCCACCTTTAGCTCTGCATTGCAGCCCAGTGCACACAGCTCA<br>GTGAGCTCGGGCTGGGCATAAAAGTCAGGGCAGAGCCATCTATTGCTTACATTTGCTTCTGG<br>GATCCAGATCTTTCGAAGCTAGCGCTACCGGTCGCCACCATGGTGAGCAAGGGCGAGGAGC<br>TGTTCACCGGGGTGGTGCCCATCCTGGTCGAGCTGGACGGCGACGTAAACGGCCACAAGTT<br>CAGCGTGTCCGGCGAGGGCGAGGGCGATGCCACCTACGGCAAGCTGACCCTGAAGCTGAT<br>CTGCACCACCGGCAAGCTGCCCGTGCCCTGGCCCACCCTCGTGACCACCCTGGGCTACGG<br>CGTGCAGTGCTTCGCCCGCTACCCCGACCACATGAAGCAGCACGACTTCTTCAAGTCCGCC<br>ATGCCCGAAGGCTACGTCCAGGAGCGCACCATCTTCTTCAAGGACGACGGCAACTACAAGA<br>CCCGCGCCGAGGTGAAGTTCGAGGGCGACACCCTGGTGAACCGCATCGAGCTGAAGGGCA<br>TCGACTTCAAGGAGGACGGCAACATCCTGGGGCACAAGCTGGAGTACAACTACAACAGCCA<br>CAACGTCTATATCACCGCCGACAAGCAGAAGAACGGCATCAAGGCCAACTTCAAGATCCGCC<br>ACAACATCGAGGACGGCGGCGTGCAGCTCGCCGACCACTACCAGCAGAACACCCCCATCGG<br>CGACGGCCCCGTGCTGCTGCCCGACAACCACTACCTGAGCTACCAGTCCAAGCTGAGCAAA<br>GACCCCAACGAGAAGCGCGATCACATGGTCCTGCTGGAGTTCGTGACCGCCGCCGGGATCA<br>CTCTCGGCATGGACGAGCTGTACAAGTAAGTCGACGGCGCGCCGCGGCCGCGAATTCGATA<br>TCATAATCAACCTCTGGATTACAAAATTTGTGAAAGATTGACTGGTATTCTTAACTATGTTGCT<br>CCTTTTACGCTATGTGGATACGCTGCTTTAATGCCTTTGTATCATGCTATTGCTTCCCGTATGG<br>CTTTCATTTTCTCCTCCTTGTATAAATCCTGGTTAGTTCTTGCCACGGCGGAACTCATCGCCG |

| Fig 26 cont'd |
| --- |
| Vector ID (length between ITRs) & Sequence Between ITRs |
| CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCGC (SEQ ID NO: 205) |
| CN2117 (1571) GCGGCCGCACGCGTGGTGTGCTCTTGGACTCCCTCTCACGTAACTTTTTTTTTATCAATGACT AGTATTAGAAAAAAAAGATTCATTGACACAGTAACTGAAAGCTGACTGGGAAATGAGAACTAA GAAGAGGAAGTCATATCCACAGTGGCTAGGTTAGAGCCACAATCAAATTAGAGAAGCAAGTC TTCTGGGCAGGCGAAAACAAATGAGGGGAGGACGGGTCTGAGCTCGGGCTGGGCATAAAAG TCAGGGCAGAGCCATCTATTGCTTACATTTGCTTCTGGGATCCAGATCTTTCGAAGCTAGCGC TACCGGTCGCCACCATGGTGAGCAAGGGCGAGGAGCTGTTCACCGGGGTGGTGCCCATCCT GGTCGAGCTGGACGGCGACGTAAACGGCCACAAGTTCAGCGTGTCCGGCGAGGGCGAGGG CGATGCCACCTACGGCAAGCTGACCCTGAAGCTGATCTGCACCACCGGCAAGCTGCCCGTG CCCTGGCCCACCCTCGTGACCACCCTGGGCTACGGCGTGCAGTGCTTCGCCCGCTACCCCG ACCACATGAAGCAGCACGACTTCTTCAAGTCCGCCATGCCCGAAGGCTACGTCCAGGAGCG CACCATCTTCTTCAAGGACGACGGCAACTACAAGACCCGCGCCGAGGTGAAGTTCGAGGGC GACACCCTGGTGAACCGCATCGAGCTGAAGGGCATCGACTTCAAGGAGGACGGCAACATCC TGGGGCACAAGCTGGAGTACAACTACAACAGCCACAACGTCTATATCACCGCCGACAAGCAG AAGAACGGCATCAAGGCCAACTTCAAGATCCGCCACAACATCGAGGACGGCGGCGTGCAGC TCGCCGACCACTACCAGCAGAACACCCCCATCGGCGACGGCCCCGTGCTGCTGCCCGACAA CCACTACCTGAGCTACCAGTCCAAGCTGAGCAAAGACCCCAACGAGAAGCGCGATCACATG GTCCTGCTGGAGTTCGTGACCGCCGCCGGGATCACTCTCGGCATGGACGAGCTGTACAAGT AAGTCGACGGCGCGCCGCGGCCGCGAATTCGATATCATAATCAACCTCTGGATTACAAAATT TGTGAAAGATTGACTGGTATTCTTAACTATGTTGCTCCTTTTACGCTATGTGGATACGCTGCTT TAATGCCTTTGTATCATGCTATTGCTTCCCGTATGGCTTTCATTTTCTCCTCCTTGTATAAATC CTGGTTAGTTCTTGCCACGGCGGAACTCATCGCCGCCTGCCTTGCCCGCTGCTGGACAGGG GCTCGGCTGTTGGGCACTGACAATTCCGTGGCTCGAGAGATCTTCGACTGTGCCTTCTAGTT GCCAGCCATCTGTTGTTTGCCCCTCCCCCGTGCCTTCCTTGACCCTGGAAGGTGCCACTCCC ACTGTCCTTTCCTAATAAAATGAGGAAATTGCATCGCATTGTCTGAGTAGGTGTCATTCTATTC TGGGGGGTGGGGTGGGGCAGGACAGCAAGGGGGAGGATTGGGAAGACAATAGCAGGCATG AGATCTCACGTGCGGACCGAGCGGCCGC (SEQ ID NO: 206) |
| CN2118 (1883) GCGGCCGCACGCGTGGAGAGTGACCTGACTACACCAGAACACATGAGTGACATGCTGAGGA TTTTGTTCCCTGATAACTGGCCTGGTCTGTACATGGACCATCTCGGGCTATTTTATCTGAGAT CATTGGAATACTCTCTCCTCTTGCCATGACTAATGCTTTTCTATCTCTGAAATATGACTTCCTT TTTGTTGATTCATGTAATAAACCTCAGAGTGCCTTGCAGGGTGTATCTAGTGTGTCATTACAC AGAACTGGAACATTCTCTGATGTGACTAGATTAACAGTACTAACGTGGTAATCACTGGAGGTC AGACATCCTGGGGAGCAGGCTGGCCTCTGTGGGTGTGGTTAGCACTCGTGATTCTGGGGAC TCAGGAGTTAGAGGAAGTACCATTTTAACCGAGGAGCTAAAGCTATCCCTACACAGAGCTGT CCTTGGATTTCCCCTGCCAAGTACTCATGTTTTCAGGTCTTACCCTCAACTGTGTCCTGCTGC TGCTGCAACTACTACTTGCAAGTAAGTCTGGGCCTGGGCGAGCTCGGGCTGGGCATAAAAG TCAGGGCAGAGCCATCTATTGCTTACATTTGCTTCTGGGATCCAGATCTTTCGAAGCTAGCGC TACCGGTCGCCACCATGGTGAGCAAGGGCGAGGAGCTGTTCACCGGGGTGGTGCCCATCCT GGTCGAGCTGGACGGCGACGTAAACGGCCACAAGTTCAGCGTGTCCGGCGAGGGCGAGGG CGATGCCACCTACGGCAAGCTGACCCTGAAGCTGATCTGCACCACCGGCAAGCTGCCCGTG CCCTGGCCCACCCTCGTGACCACCCTGGGCTACGGCGTGCAGTGCTTCGCCCGCTACCCCG ACCACATGAAGCAGCACGACTTCTTCAAGTCCGCCATGCCCGAAGGCTACGTCCAGGAGCG |

| Fig 26 cont'd |
|---|
| Vector ID (length between ITRs) & Sequence Between ITRs |
| CACCATCTTCTTCAAGGACGACGGCAACTACAAGACCCGCGCCGAGGTGAAGTTCGAGGGC GACACCCTGGTGAACCGCATCGAGCTGAAGGGCATCGACTTCAAGGAGGACGGCAACATCC TGGGGCACAAGCTGGAGTACAACTACAACAGCCACAACGTCTATATCACCGCCGACAAGCAG AAGAACGGCATCAAGGCCAACTTCAAGATCCGCCACAACATCGAGGACGGCGGCGTGCAGC TCGCCGACCACTACCAGCAGAACACCCCCATCGGCGACGGCCCCGTGCTGCTGCCCGACAA CCACTACCTGAGCTACCAGTCCAAGCTGAGCAAAGACCCCAACGAGAAGCGCGATCACATG GTCCTGCTGGAGTTCGTGACCGCCGCCGGGATCACTCTCGGCATGGACGAGCTGTACAAGT AAGTCGACGGCGCGCCGCGGCCGCGAATTCGATATCATAATCAACCTCTGGATTACAAAATT TGTGAAAGATTGACTGGTATTCTTAACTATGTTGCTCCTTTTACGCTATGTGGATACGCTGCTT TAATGCCTTTGTATCATGCTATTGCTTCCCGTATGGCTTTCATTTTCTCCTCCTTGTATAAATC CTGGTTAGTTCTTGCCACGGCGGAACTCATCGCCGCCTGCCTTGCCCGCTGCTGGACAGGG GCTCGGCTGTTGGGCACTGACAATTCCGTGGCTCGAGAGATCTTCGACTGTGCCTTCTAGTT GCCAGCCATCTGTTGTTTGCCCCTCCCCCGTGCCTTCCTTGACCCTGGAAGGTGCCACTCCC ACTGTCCTTTCCTAATAAAATGAGGAAATTGCATCGCATTGTCTGAGTAGGTGTCATTCTATTC TGGGGGGTGGGGTGGGGCAGGACAGCAAGGGGGAGGATTGGGAAGACAATAGCAGGCATG AGATCTCACGTGCGGACCGAGCGGCCGC (SEQ ID NO: 207) |
| CN2119 (1673) GCGGCCGCACGCGTTTGAACTTGCAGGGGGCTCATTAGGTGTCCAGAGACTTTTGCTGATG GATAGCATGCACTGGGCATGAGCCTGCTGGCTTTGACATTTTCAAACTGCACACTTCCTACA GCGACAGCGTGCCAAAGCCATGGGCCTCACTGCCATCTTCTCAAAACCAGGAAATGAAACTG GCCACTAAGAGCAAGTGACCACGAGCCAGGGCATTGGTGCAAACCAAGCAAAACACGCTGT CGGCAGCCTAGGTCACAAGGAGGAACGCATCTCATTTGCAGCAATCTTTGAAGAAATGGTCC ACTCCTGCTCCTCATCCTGGCGAGCTCGGGCTGGGCATAAAAGTCAGGGCAGAGCCATCTA TTGCTTACATTTGCTTCTGGGATCCAGATCTTTCGAAGCTAGCGCTACCGGTCGCCACCATG GTGAGCAAGGGCGAGGAGCTGTTCACCGGGGTGGTGCCCATCCTGGTCGAGCTGGACGGC GACGTAAACGGCCACAAGTTCAGCGTGTCCGGCGAGGGCGAGGGCGATGCCACCTACGGC AAGCTGACCCTGAAGCTGATCTGCACCACCGGCAAGCTGCCCGTGCCCTGGCCCACCCTCG TGACCACCCTGGGCTACGGCGTGCAGTGCTTCGCCCGCTACCCCGACCACATGAAGCAGCA CGACTTCTTCAAGTCCGCCATGCCCGAAGGCTACGTCCAGGAGCGCACCATCTTCTTCAAGG ACGACGGCAACTACAAGACCCGCGCCGAGGTGAAGTTCGAGGGCGACACCCTGGTGAACC GCATCGAGCTGAAGGGCATCGACTTCAAGGAGGACGGCAACATCCTGGGGCACAAGCTGGA GTACAACTACAACAGCCACAACGTCTATATCACCGCCGACAAGCAGAAGAACGGCATCAAGG CCAACTTCAAGATCCGCCACAACATCGAGGACGGCGGCGTGCAGCTCGCCGACCACTACCA GCAGAACACCCCCATCGGCGACGGCCCCGTGCTGCTGCCCGACAACCACTACCTGAGCTAC CAGTCCAAGCTGAGCAAAGACCCCAACGAGAAGCGCGATCACATGGTCCTGCTGGAGTTCG TGACCGCCGCCGGGATCACTCTCGGCATGGACGAGCTGTACAAGTAAGTCGACGGCGCGCC GCGGCCGCGAATTCGATATCATAATCAACCTCTGGATTACAAAATTTGTGAAAGATTGACTGG TATTCTTAACTATGTTGCTCCTTTTACGCTATGTGGATACGCTGCTTTAATGCCTTTGTATCAT GCTATTGCTTCCCGTATGGCTTTCATTTTCTCCTCCTTGTATAAATCCTGGTTAGTTCTTGCCA CGGCGGAACTCATCGCCGCCTGCCTTGCCCGCTGCTGGACAGGGGCTCGGCTGTTGGGCA CTGACAATTCCGTGGCTCGAGAGATCTTCGACTGTGCCTTCTAGTTGCCAGCCATCTGTTGTT TGCCCCTCCCCCGTGCCTTCCTTGACCCTGGAAGGTGCCACTCCCACTGTCCTTTCCTAATA AAATGAGGAAATTGCATCGCATTGTCTGAGTAGGTGTCATTCTATTCTGGGGGGTGGGGTGG GGCAGGACAGCAAGGGGGAGGATTGGGAAGACAATAGCAGGCATGAGATCTCACGTGCGG ACCGAGCGGCCGC (SEQ ID NO: 208) |
| CN2120 (1867) GCGGCCGCACGCGTTGACACTTGCAAGCAGTTCACTTATTATGGAAAAGCATGGCTTCAGTG GCCACCAGCGCAGTGGGAGGAGACCTGAAGAACACAAAACAATTCCGTCCTCTGTATCTTCA GTAGAGCTGGCTCCAGAAGAGGGTCCAGTTCTGAAACATGGAACATTCTCCCCATTGGGCTC |

| Fig 26 cont'd |
| --- |
| Vector ID (length between ITRs) & Sequence Between ITRs |
| TCTGGGAAAAGGCCTCAGTATTGTAGAGGGTGCCTCTAGCTATTCAGGTCTTGCCAAGGAGA ACGGCCAAGAAAGACAAGAGGTCACATGGCCAGGCCTGCAGCCGGCACAAAATGTTCTGAG CAACTAACTGATGGCTGGACAGGGACCAGGACTGACCCTGACCCTACGTTGAGTTTTCTAAG AGAGGTAGGCCAACACATGATGCAAAGGATTCTATTGTTGCTTCTGCAAAGCAAGATTTGAGT TAACATGAGTTGTATGTCTCTTCTAAATGAAGAGACATGAATTTTTTTTCTCATATGTACTTTTT TAAACATTGCAATAACCCAGTTACGAGCTCGGGCTGGGCATAAAAGTCAGGGCAGAGCCATC TATTGCTTACATTTGCTTCTGGGATCCAGATCTTTCGAAGCTAGCGCTACCGGTCGCCACCAT GGTGAGCAAGGGCGAGGAGCTGTTCACCGGGGTGGTGCCCATCCTGGTCGAGCTGGACGG CGACGTAAACGGCCACAAGTTCAGCGTGTCCGGCGAGGGCGAGGGCGATGCCACCTACGG CAAGCTGACCCTGAAGCTGATCTGCACCACCGGCAAGCTGCCCGTGCCCTGGCCCACCCTC GTGACCACCCTGGGCTACGGCGTGCAGTGCTTCGCCCGCTACCCCGACCACATGAAGCAGC ACGACTTCTTCAAGTCCGCCATGCCCGAAGGCTACGTCCAGGAGCGCACCATCTTCTTCAAG GACGACGGCAACTACAAGACCCGCGCCGAGGTGAAGTTCGAGGGCGACACCCTGGTGAAC CGCATCGAGCTGAAGGGCATCGACTTCAAGGAGGACGGCAACATCCTGGGGCACAAGCTGG AGTACAACTACAACAGCCACAACGTCTATATCACCGCCGACAAGCAGAAGAACGGCATCAAG GCCAACTTCAAGATCCGCCACAACATCGAGGACGGCGGCGTGCAGCTCGCCGACCACTACC AGCAGAACACCCCCATCGGCGACGGCCCCGTGCTGCTGCCCGACAACCACTACCTGAGCTA CCAGTCCAAGCTGAGCAAAGACCCCAACGAGAAGCGCGATCACATGGTCCTGCTGGAGTTC GTGACCGCCGCCGGGATCACTCTCGGCATGGACGAGCTGTACAAGTAAGTCGACGGCGCG CCGCGGCCGCGAATTCGATATCATAATCAACCTCTGGATTACAAAATTTGTGAAAGATTGACT GGTATTCTTAACTATGTTGCTCCTTTTACGCTATGTGGATACGCTGCTTTAATGCCTTTGTATC ATGCTATTGCTTCCCGTATGGCTTTCATTTTCTCCTCCTTGTATAAATCCTGGTTAGTTCTTGC CACGGCGGAACTCATCGCCGCCTGCCTTGCCCGCTGCTGGACAGGGGCTCGGCTGTTGGG CACTGACAATTCCGTGGCTCGAGAGATCTTCGACTGTGCCTTCTAGTTGCCAGCCATCTGTT GTTTGCCCCTCCCCCGTGCCTTCCTTGACCCTGGAAGGTGCCACTCCCACTGTCCTTTCCTA ATAAAATGAGGAAATTGCATCGCATTGTCTGAGTAGGTGTCATTCTATTCTGGGGGGTGGGG TGGGGCAGGACAGCAAGGGGGAGGATTGGGAAGACAATAGCAGGCATGAGATCTCACGTG CGGACCGAGCGGCCGC (SEQ ID NO: 209) |
| CN2121 (1861) GCGGCCGCACGCGTGGCTGAGCCCTGTACTGACCAAGCAACCTGCAGAGGGTGGGGGCGA CTGAGGGAGCCTGGCTTTGGGGGTCAGCTTTGTCCTGTTAGATGGAGGGACGGACACCAGA GGTTTGGGGACTTTCCTTCGTCTCACTTCTACCTGAGGGGTGGGGGAAGGTAGAAAGGCTA GAATGCTGGTTGGCAGGGCTTGAGTTCAGGCAGTCCTGGGAACCTTGCCTGAAGTGCCTGA GACAGAACAGCCATGAAGGCTGGCCTGACCAGGCTAGCCAAGGGGCAGGAGCAGGGCATT TTTCATTCATATTCCTGCCTCTGCATGGCAGCCCACATTGCCACCCCTGTTCCTGGGCTCCCA GCCTGATCCCAGGCTCTGCCTGCCCCTTGGCAGCCACCACCCAGCCTATCCACCCAGATAC TTTCGAATTCCCATGCTTCTAACCGCTCCCTGGCCCCTGTGGGGTAGGTGTGCTGAAAGAGG CTCAGGCACAATGTGGATGTGTACATGTGAGCTCGGGCTGGGCATAAAAGTCAGGGCAGAG CCATCTATTGCTTACATTTGCTTCTGGGATCCAGATCTTTCGAAGCTAGCGCTACCGGTCGCC ACCATGGTGAGCAAGGGCGAGGAGCTGTTCACCGGGGTGGTGCCCATCCTGGTCGAGCTG GACGGCGACGTAAACGGCCACAAGTTCAGCGTGTCCGGCGAGGGCGAGGGCGATGCCACC TACGGCAAGCTGACCCTGAAGCTGATCTGCACCACCGGCAAGCTGCCCGTGCCCTGGCCCA CCCTCGTGACCACCCTGGGCTACGGCGTGCAGTGCTTCGCCCGCTACCCCGACCACATGAA GCAGCACGACTTCTTCAAGTCCGCCATGCCCGAAGGCTACGTCCAGGAGCGCACCATCTTCT TCAAGGACGACGGCAACTACAAGACCCGCGCCGAGGTGAAGTTCGAGGGCGACACCCTGGT GAACCGCATCGAGCTGAAGGGCATCGACTTCAAGGAGGACGGCAACATCCTGGGGCACAAG CTGGAGTACAACTACAACAGCCACAACGTCTATATCACCGCCGACAAGCAGAAGAACGGCAT CAAGGCCAACTTCAAGATCCGCCACAACATCGAGGACGGCGGCGTGCAGCTCGCCGACCAC TACCAGCAGAACACCCCCATCGGCGACGGCCCCGTGCTGCTGCCCGACAACCACTACCTGA |

| Fig 26 cont'd |
| --- |
| Vector ID (length between ITRs) & Sequence Between ITRs |
| GCTACCAGTCCAAGCTGAGCAAAGACCCCAACGAGAAGCGCGATCACATGGTCCTGCTGGA GTTCGTGACCGCCGCCGGGATCACTCTCGGCATGGACGAGCTGTACAAGTAAGTCGACGGC GCGCCGCGGCCGCGAATTCGATATCATAATCAACCTCTGGATTACAAAATTTGTGAAAGATTG ACTGGTATTCTTAACTATGTTGCTCCTTTTACGCTATGTGGATACGCTGCTTTAATGCCTTTGT ATCATGCTATTGCTTCCCGTATGGCTTTCATTTTCTCCTCCTTGTATAAATCCTGGTTAGTTCT TGCCACGGCGGAACTCATCGCCGCCTGCCTTGCCCGCTGCTGGACAGGGGCTCGGCTGTT GGGCACTGACAATTCCGTGGCTCGAGAGATCTTCGACTGTGCCTTCTAGTTGCCAGCCATCT GTTGTTTGCCCCTCCCCCGTGCCTTCCTTGACCCTGGAAGGTGCCACTCCCACTGTCCTTTC CTAATAAAATGAGGAAATTGCATCGCATTGTCTGAGTAGGTGTCATTCTATTCTGGGGGGTGG GGTGGGGCAGGACAGCAAGGGGGAGGATTGGGAAGACAATAGCAGGCATGAGATCTCACG TGCGGACCGAGCGGCCGC (SEQ ID NO: 210) |
| CN2122 (2012) GCGGCCGCACGCGTGCCCTCCCGCTTCTTTCTTGTCTTCAACAAGAAATTAATATCTCAAGAT AACTCCGATGTGTTGGTCCCAGCCAGAACACTTGAAAGACACGTTCAATTAGGGCCACAGCA TTGCTTCTGGAGTGAACGGCTATCACACTGCCCTGGAGTTCAGTCTCCTCTGCACACACATA AACACAAGTGCACAGCGCCCCAATGCTGTTGTCCCCTCAGCCTTCCAGCACTGCCAGTTGGC AAACCCAAGCCAGGAAGTTGTCAATTCCAATTGCGTTTAGGCCATGTAGTCCTATTAAAGAAG GCTTGCTGGTTAAGGGGCATCCTCTGTTTCCAAAGCATGGGAAAAAAGAAAAAAAAAAAAAA GGCTGTGCTTAGATTGGAGCTGGCAACTTCCACTGACTAGAATTTTCAAGGGGCTGTGAATG AGTTTAACAAAGGAGGTCTGTGGCTAGTTTCTGGCTGAAGTCCATGTCAACAGTTTTTAAGGT CACAGGCCACACTAACTAACATTTATTCCCAGCAGACCCTGTTCTAAACACAAGCTGTACATA GTACAAATTTGAAATTTTTCTGTAATCCCTTGAGATATTCCTGATCCCTCCACATGTTTCTGCT CAATTAAAAACAATTCTCACTTCTCACCACAAGAGAGGCCAGAGCTCGGGCTGGGCATAAAA GTCAGGGCAGAGCCATCTATTGCTTACATTTGCTTCTGGGATCCAGATCTTTCGAAGCTAGC GCTACCGGTCGCCACCATGGTGAGCAAGGGCGAGGAGCTGTTCACCGGGGTGGTGCCCAT CCTGGTCGAGCTGGACGGCGACGTAAACGGCCACAAGTTCAGCGTGTCCGGCGAGGGCGA GGGCGATGCCACCTACGGCAAGCTGACCCTGAAGCTGATCTGCACCACCGGCAAGCTGCCC GTGCCCTGGCCCACCCTCGTGACCACCCTGGGCTACGGCGTGCAGTGCTTCGCCCGCTACC CCGACCACATGAAGCAGCACGACTTCTTCAAGTCCGCCATGCCCGAAGGCTACGTCCAGGA GCGCACCATCTTCTTCAAGGACGACGGCAACTACAAGACCCGCGCCGAGGTGAAGTTCGAG GGCGACACCCTGGTGAACCGCATCGAGCTGAAGGGCATCGACTTCAAGGAGGACGGCAACA TCCTGGGGCACAAGCTGGAGTACAACTACAACAGCCACAACGTCTATATCACCGCCGACAAG CAGAAGAACGGCATCAAGGCCAACTTCAAGATCCGCCACAACATCGAGGACGGCGGCGTGC AGCTCGCCGACCACTACCAGCAGAACACCCCCATCGGCGACGGCCCCGTGCTGCTGCCCG ACAACCACTACCTGAGCTACCAGTCCAAGCTGAGCAAAGACCCCAACGAGAAGCGCGATCA CATGGTCCTGCTGGAGTTCGTGACCGCCGCCGGGATCACTCTCGGCATGGACGAGCTGTAC AAGTAAGTCGACGGCGCGCCGCGGCCGCGAATTCGATATCATAATCAACCTCTGGATTACAA AATTTGTGAAAGATTGACTGGTATTCTTAACTATGTTGCTCCTTTTACGCTATGTGGATACGCT GCTTTAATGCCTTTGTATCATGCTATTGCTTCCCGTATGGCTTTCATTTTCTCCTCCTTGTATA AATCCTGGTTAGTTCTTGCCACGGCGGAACTCATCGCCGCCTGCCTTGCCCGCTGCTGGACA GGGGCTCGGCTGTTGGGCACTGACAATTCCGTGGCTCGAGAGATCTTCGACTGTGCCTTCTA GTTGCCAGCCATCTGTTGTTTGCCCCTCCCCCGTGCCTTCCTTGACCCTGGAAGGTGCCACT CCCACTGTCCTTTCCTAATAAAATGAGGAAATTGCATCGCATTGTCTGAGTAGGTGTCATTCT ATTCTGGGGGGTGGGGTGGGGCAGGACAGCAAGGGGGAGGATTGGGAAGACAATAGCAGG CATGAGATCTCACGTGCGGACCGAGCGGCCGC (SEQ ID NO: 211) |
| CN2123 (1804) GCGGCCGCACGCGTAAGCCGCTTTGAATGCTGCATGAAACAGCTAAATTCGTTCTGCTCTTG AATGAGTTCCCTTAGCGGGCAATAGTTTTCTGAGGCTTTGAAATGATCACTAATACTCGAGTG AGTCTTACAGCACTTCTGGAGTGGACCAGAGCACTTCTCAATACAAACCAGCAGATGAGGTC |

| Fig 26 cont'd |
|---|
| Vector ID (length between ITRs) & Sequence Between ITRs |
| ATGGTCATGCAAGTCGTCGGGGGGGGGGGGGGGTGGCAGCAACAATCATTGTCAAAGGGGTGT<br>TTTCTGTAGATGAGAGAATGAAACTATTGTACAAAACTCAATGGGCGCCAAGCATGTGGCCCA<br>ATTATTTCGCCTGTATGAGCATGGCACGGAAGGCTCTCCTTAGAGAACTCAATTCACACATTT<br>GTGTTTTGTCTTGTATTCATGGGCAAAAGCCTAGAGACTTTCAACCTAAGAGGCTTCACCAAG<br>TTCCTGTCTTTTAAACCTAGAACGAGCTCGGGCTGGGCATAAAAGTCAGGGCAGAGCCATCT<br>ATTGCTTACATTTGCTTCTGGGATCCAGATCTTTCGAAGCTAGCGCTACCGGTCGCCACCATG<br>GTGAGCAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCTACGGC<br>AAGCTGACCCTGAAGCTGATCTGCACCACCGGCAAGCTGCCCGTGCCCTGGCCCACCCTCG<br>TGACCACCCTGGGCTACGGCGTGCAGTGCTTCGCCCGCTACCCCGACCACATGAAGCAGCA<br>CGACTTCTTCAAGTCCGCCATGCCCGAAGGCTACGTCCAGGAGCGCACCATCTTCTTCAAGG<br>ACGACGGCAACTACAAGACCCGCGCCGAGGTGAAGTTCGAGGGCGACACCCTGGTGAACC<br>GCATCGAGCTGAAGGGCATCGACTTCAAGGAGGACGGCAACATCCTGGGGCACAAGCTGGA<br>GTACAACTACAACAGCCACAACGTCTATATCACCGCCGACAAGCAGAAGAACGGCATCAAGG<br>CCAACTTCAAGATCCGCCACAACATCGAGGACGGCGGCGTGCAGCTCGCCGACCACTACCA<br>GCAGAACACCCCCATCGGCGACGGCCCCGTGCTGCTGCCCGACAACCACTACCTGAGCTAC<br>CAGTCCAAGCTGAGCAAAGACCCCAACGAGAAGCGCGATCACATGGTCCTGCTGGAGTTCG<br>TGACCGCCGCCGGGATCACTCTCGGCATGGACGAGCTGTACAAGTAAGTCGACGGCGCGCC<br>GCGGCCGCGAATTCGATATCATAATCAACCTCTGGATTACAAAATTTGTGAAAGATTGACTGG<br>TATTCTTAACTATGTTGCTCCTTTTACGCTATGTGGATACGCTGCTTTAATGCCTTTGTATCAT<br>GCTATTGCTTCCCGTATGGCTTTCATTTTCTCCTCCTTGTATAAATCCTGGTTAGTTCTTGCCA<br>CGGCGGAACTCATCGCCGCCTGCCTTGCCCGCTGCTGGACAGGGGCTCGGCTGTTGGGCA<br>CTGACAATTCCGTGGCTCGAGAGATCTTCGACTGTGCCTTCTAGTTGCCAGCCATCTGTTGTT<br>TGCCCCTCCCCCGTGCCTTCCTTGACCCTGGAAGGTGCCACTCCCACTGTCCTTTCCTAATA<br>AAATGAGGAAATTGCATCGCATTGTCTGAGTAGGTGTCATTCTATTCTGGGGGGTGGGGTGG<br>GGCAGGACAGCAAGGGGGAGGATTGGGAAGACAATAGCAGGCATGAGATCTCACGTGCGG<br>ACCGAGCGGCCGC (SEQ ID NO: 212) |
| CN2124 (1673)<br>GCGGCCGCACGCGTTACGGCCTGGGAATGCAGAGTGACAGGGTTGATAATCTGCATGGCTC<br>TTCCCCACTCAAGTGCTCAGTGGTCAACAGCAACAGGACAACACGGGCTTATGTCCTGAGGA<br>AGGCAGCTGCTGGGGACAGGGGTGGAACAGAGGCAGCTGGGGGTGGAGAGGAGCCTGTTA<br>CCAGCTGCACAATGGATTTCTCAGCTACCAGCAACCCCTCTGGGTGACACCTAGCTATTACA<br>GTTCTCATAGCCAGCTCTCCTCATAGGGCAAGAAGAAAGTATGGCTCCAGGGAGTGGCCCCT<br>GCACACGCTAATGCTATGCCCTGAGCTCGGGCTGGGCATAAAAGTCAGGGCAGAGCCATCT<br>ATTGCTTACATTTGCTTCTGGGATCCAGATCTTTCGAAGCTAGCGCTACCGGTCGCCACCATG<br>GTGAGCAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCTACGGC<br>AAGCTGACCCTGAAGCTGATCTGCACCACCGGCAAGCTGCCCGTGCCCTGGCCCACCCTCG<br>TGACCACCCTGGGCTACGGCGTGCAGTGCTTCGCCCGCTACCCCGACCACATGAAGCAGCA<br>CGACTTCTTCAAGTCCGCCATGCCCGAAGGCTACGTCCAGGAGCGCACCATCTTCTTCAAGG<br>ACGACGGCAACTACAAGACCCGCGCCGAGGTGAAGTTCGAGGGCGACACCCTGGTGAACC<br>GCATCGAGCTGAAGGGCATCGACTTCAAGGAGGACGGCAACATCCTGGGGCACAAGCTGGA<br>GTACAACTACAACAGCCACAACGTCTATATCACCGCCGACAAGCAGAAGAACGGCATCAAGG<br>CCAACTTCAAGATCCGCCACAACATCGAGGACGGCGGCGTGCAGCTCGCCGACCACTACCA<br>GCAGAACACCCCCATCGGCGACGGCCCCGTGCTGCTGCCCGACAACCACTACCTGAGCTAC<br>CAGTCCAAGCTGAGCAAAGACCCCAACGAGAAGCGCGATCACATGGTCCTGCTGGAGTTCG<br>TGACCGCCGCCGGGATCACTCTCGGCATGGACGAGCTGTACAAGTAAGTCGACGGCGCGCC<br>GCGGCCGCGAATTCGATATCATAATCAACCTCTGGATTACAAAATTTGTGAAAGATTGACTGG<br>TATTCTTAACTATGTTGCTCCTTTTACGCTATGTGGATACGCTGCTTTAATGCCTTTGTATCAT |

| Fig 26 cont'd |
| --- |
| Vector ID (length between ITRs) & Sequence Between ITRs |
| GCTATTGCTTCCCGTATGGCTTTCATTTTCTCCTCCTTGTATAAATCCTGGTTAGTTCTTGCCA CGGCGGAACTCATCGCCGCCTGCCTTGCCCGCTGCTGGACAGGGGCTCGGCTGTTGGGCA CTGACAATTCCGTGGCTCGAGAGATCTTCGACTGTGCCTTCTAGTTGCCAGCCATCTGTTGTT TGCCCCTCCCCCGTGCCTTCCTTGACCCTGGAAGGTGCCACTCCCACTGTCCTTTCCTAATA AAATGAGGAAATTGCATCGCATTGTCTGAGTAGGTGTCATTCTATTCTGGGGGGTGGGGTGG GGCAGGACAGCAAGGGGGAGGATTGGGAAGACAATAGCAGGCATGAGATCTCACGTGCGG ACCGAGCGGCCGC (SEQ ID NO: 213) |
| CN2125 (1751)<br>GCGGCCGCACGCGTCTTCAGGCGCTGGGAAGCTACCCAGGGAGTCAGAGAGCCAGAGCAA CTAGGACTCAACTCTGTAGAGACAAGCTAGCATCTGATCTAGCCCTGTTGCCTTGACAATGG CTCATATCCCAGGCACCCTAGGCACCCACAGGAGCAATTAGTGAGTGTGGGAGAGGGTTTCT ATGGTGGCGGTCCCAAGGACCTAGGGAAGAACAAGGGCCAGCAGGACCTTTCTCCTTTGTC CTGAGCACACTAGGCCTTTGTTCTTCTCTGGCTCTCTTTGACAGATGGGAGCAGGAACATGG TTAGGGAGGCCAACATGGTTTAAAGTCCCCCACCGATGGGAGCCCTGAGCCATCTAGGGGA GGCTATGGGAGGTTGAAGTGCCTCTCTGGGACTCAGCTGGAGCTCGGGCTGGGCATAAAAG TCAGGGCAGAGCCATCTATTGCTTACATTTGCTTCTGGGATCCAGATCTTTCGAAGCTAGCGC TACCGGTCGCCACCATGGTGAGCAAGGGCGAGGAGCTGTTCACCGGGGTGGTGCCCATCCT GGTCGAGCTGGACGGCGACGTAAACGGCCACAAGTTCAGCGTGTCCGGCGAGGGCGAGGG CGATGCCACCTACGGCAAGCTGACCCTGAAGCTGATCTGCACCACCGGCAAGCTGCCCGTG CCCTGGCCCACCCTCGTGACCACCCTGGGCTACGGCGTGCAGTGCTTCGCCCGCTACCCCG ACCACATGAAGCAGCACGACTTCTTCAAGTCCGCCATGCCCGAAGGCTACGTCCAGGAGCG CACCATCTTCTTCAAGGACGACGGCAACTACAAGACCCGCGCCGAGGTGAAGTTCGAGGGC GACACCCTGGTGAACCGCATCGAGCTGAAGGGCATCGACTTCAAGGAGGACGGCAACATCC TGGGGCACAAGCTGGAGTACAACTACAACAGCCACAACGTCTATATCACCGCCGACAAGCAG AAGAACGGCATCAAGGCCAACTTCAAGATCCGCCACAACATCGAGGACGGCGGCGTGCAGC TCGCCGACCACTACCAGCAGAACACCCCCATCGGCGACGGCCCCGTGCTGCTGCCCGACAA CCACTACCTGAGCTACCAGTCCAAGCTGAGCAAAGACCCCAACGAGAAGCGCGATCACATG GTCCTGCTGGAGTTCGTGACCGCCGCCGGGATCACTCTCGGCATGGACGAGCTGTACAAGT AAGTCGACGGCGCGCCGCGGCCGCGAATTCGATATCATAATCAACCTCTGGATTACAAAATT TGTGAAAGATTGACTGGTATTCTTAACTATGTTGCTCCTTTTACGCTATGTGGATACGCTGCTT TAATGCCTTTGTATCATGCTATTGCTTCCCGTATGGCTTTCATTTTCTCCTCCTTGTATAAATC CTGGTTAGTTCTTGCCACGGCGGAACTCATCGCCGCCTGCCTTGCCCGCTGCTGGACAGGG GCTCGGCTGTTGGGCACTGACAATTCCGTGGCTCGAGAGATCTTCGACTGTGCCTTCTAGTT GCCAGCCATCTGTTGTTTGCCCCTCCCCCGTGCCTTCCTTGACCCTGGAAGGTGCCACTCCC ACTGTCCTTTCCTAATAAAATGAGGAAATTGCATCGCATTGTCTGAGTAGGTGTCATTCTATTC TGGGGGGTGGGGTGGGGCAGGACAGCAAGGGGGAGGATTGGGAAGACAATAGCAGGCATG AGATCTCACGTGCGGACCGAGCGGCCGC (SEQ ID NO: 214) |
| CN2126 (1687)<br>GCGGCCGCACGCGTCCACATTCTTTGCTCTCACCTCCTGACCTTTCGACCAGGAAAGAGAGC CACCAGTTGCTGGTGCTCCCTCCCACACCTAGTTAGCTGGGTCCTGGAGGCATCTTCCCAGC GGGGCATCTCTGAGCTTGGTGGCTCTGCACTGGCAGTGGGCCCTGCTCAGCAAAGAAAGAA CAATATGGACTCTGTTCTCAATTAGTGTGTAACCCTCGGGGCAGGCACAGGCTCACTCCTGC TCCCCTGTACTTTAATGGCCTAGTCTGATGTTCCTACAGCTCGGGGCCAGGTGGGGCAAGAG CCCAGAAACAGGAGAGCACCTTGCATTCCCTGGAGAGCTCGGGCTGGGCATAAAAGTCAGG GCAGAGCCATCTATTGCTTACATTTGCTTCTGGGATCCAGATCTTTCGAAGCTAGCGCTACCG GTCGCCACCATGGTGAGCAAGGGCGAGGAGCTGTTCACCGGGGTGGTGCCCATCCTGGTC GAGCTGGACGGCGACGTAAACGGCCACAAGTTCAGCGTGTCCGGCGAGGGCGAGGGCGAT GCCACCTACGGCAAGCTGACCCTGAAGCTGATCTGCACCACCGGCAAGCTGCCCGTGCCCT GGCCCACCCTCGTGACCACCCTGGGCTACGGCGTGCAGTGCTTCGCCCGCTACCCCGACCA |

| Fig 26 cont'd |
| --- |
| Vector ID (length between ITRs) & Sequence Between ITRs |
| CATGAAGCAGCACGACTTCTTCAAGTCCGCCATGCCCGAAGGCTACGTCCAGGAGCGCACC |
| ATCTTCTTCAAGGACGACGGCAACTACAAGACCCGCGCCGAGGTGAAGTTCGAGGGCGACA |
| CCCTGGTGAACCGCATCGAGCTGAAGGGCATCGACTTCAAGGAGGACGGCAACATCCTGGG |
| GCACAAGCTGGAGTACAACTACAACAGCCACAACGTCTATATCACCGCCGACAAGCAGAAGA |
| ACGGCATCAAGGCCAACTTCAAGATCCGCCACAACATCGAGGACGGCGGCGTGCAGCTCGC |
| CGACCACTACCAGCAGAACACCCCCATCGGCGACGGCCCCGTGCTGCTGCCCGACAACCAC |
| TACCTGAGCTACCAGTCCAAGCTGAGCAAAGACCCCAACGAGAAGCGCGATCACATGGTCCT |
| GCTGGAGTTCGTGACCGCCGCCGGGATCACTCTCGGCATGGACGAGCTGTACAAGTAAGTC |
| GACGGCGCGCCGCGGCCGCGAATTCGATATCATAATCAACCTCTGGATTACAAAATTTGTGA |
| AAGATTGACTGGTATTCTTAACTATGTTGCTCCTTTTACGCTATGTGGATACGCTGCTTTAATG |
| CCTTTGTATCATGCTATTGCTTCCCGTATGGCTTTCATTTTCTCCTCCTTGTATAAATCCTGGT |
| TAGTTCTTGCCACGGCGGAACTCATCGCCGCCTGCCTTGCCCGCTGCTGGACAGGGGCTCG |
| GCTGTTGGGCACTGACAATTCCGTGGCTCGAGAGATCTTCGACTGTGCCTTCTAGTTGCCAG |
| CCATCTGTTGTTTGCCCCTCCCCCGTGCCTTCCTTGACCCTGGAAGGTGCCACTCCCACTGT |
| CCTTTCCTAATAAAATGAGGAAATTGCATCGCATTGTCTGAGTAGGTGTCATTCTATTCTGGG |
| GGGTGGGGTGGGGCAGGACAGCAAGGGGGAGGATTGGGAAGACAATAGCAGGCATGAGAT |
| CTCACGTGCGGACCGAGCGGCCGC (SEQ ID NO: 215) |

| CN2127 (2030) |
| --- |
| GCGGCCGCACGCGTTCGGACTTTGCTTACCGTGTCTTCTCATGCTAGATTAGCTGTTAGTAA |
| CACACACTAGTTGTCTCCAAGACCAGATGGACAGGAAAACCTTGAATTACCACCTTCATGTAA |
| TTCCACGCCAGATATCTCAGCAGACACATACACACACACAAACCTCTTATTGCTCCCCTGAAA |
| GGGCATCTGAGAGTAGGGCTCCTGAAAATGTGTGCAGCCTGTGATAATGGGGCACACAGTA |
| GACAAAAGGGCAGAAGAAAAATGAGGCTTTAATAGGCACACTATCTAGGTCATTTATCCTTGG |
| ATAATGGGAAAAAAACACAATGTCGTAGTGTCAGCAAGGGACACAAAGGCATTCTGGTGTCC |
| TGCAGACCAGAGCTTGATATCAAGAGCCAGTGTGTGGAAAAACCCACGTGGAACTAAAATGG |
| ACCCATTTAAGTGTGTGTGTGTGTGTGTGTGCGCACGCATGCGTGCACATTCACGAGCAT |
| GAACTCACATTCACCCAGTCTCAAGGACTACTAGATTATTAAATCCTTTATTTGTTTTCTACAAT |
| AAGGTTTAAATTATAAGACCTTTTTCTATGTCATTTCAGCAAACCCTATTTCCATCTAAGAAAG |
| GAGTGATATACATGGAATTGTGCTTGTCTTTTACCTTCCCATACCCCCTTTACACACCAGAGC |
| TCGGGCTGGGCATAAAAGTCAGGGCAGAGCCATCTATTGCTTACATTTGCTTCTGGGATCCA |
| GATCTTTCGAAGCTAGCGCTACCGGTCGCCACCATGGTGAGCAAGGGCGAGGAGCTGTTCA |
| CCGGGGTGGTGCCCATCCTGGTCGAGCTGGACGGCGACGTAAACGGCCACAAGTTCAGCG |
| TGTCCGGCGAGGGCGAGGGCGATGCCACCTACGGCAAGCTGACCCTGAAGCTGATCTGCA |
| CCACCGGCAAGCTGCCCGTGCCCTGGCCCACCCTCGTGACCACCCTGGGCTACGGCGTGC |
| AGTGCTTCGCCCGCTACCCCGACCACATGAAGCAGCACGACTTCTTCAAGTCCGCCATGCCC |
| GAAGGCTACGTCCAGGAGCGCACCATCTTCTTCAAGGACGACGGCAACTACAAGACCCGCG |
| CCGAGGTGAAGTTCGAGGGCGACACCCTGGTGAACCGCATCGAGCTGAAGGGCATCGACTT |
| CAAGGAGGACGGCAACATCCTGGGGCACAAGCTGGAGTACAACTACAACAGCCACAACGTC |
| TATATCACCGCCGACAAGCAGAAGAACGGCATCAAGGCCAACTTCAAGATCCGCCACAACAT |
| CGAGGACGGCGGCGTGCAGCTCGCCGACCACTACCAGCAGAACACCCCCATCGGCGACGG |
| CCCCGTGCTGCTGCCCGACAACCACTACCTGAGCTACCAGTCCAAGCTGAGCAAAGACCCC |
| AACGAGAAGCGCGATCACATGGTCCTGCTGGAGTTCGTGACCGCCGCCGGGATCACTCTCG |
| GCATGGACGAGCTGTACAAGTAAGTCGACGGCGCGCCGCGGCCGCGAATTCGATATCATAA |
| TCAACCTCTGGATTACAAAATTTGTGAAAGATTGACTGGTATTCTTAACTATGTTGCTCCTTTT |
| ACGCTATGTGGATACGCTGCTTTAATGCCTTTGTATCATGCTATTGCTTCCCGTATGGCTTTC |
| ATTTTCTCCTCCTTGTATAAATCCTGGTTAGTTCTTGCCACGGCGGAACTCATCGCCGCCTGC |
| CTTGCCCGCTGCTGGACAGGGGCTCGGCTGTTGGGCACTGACAATTCCGTGGCTCGAGAGA |
| TCTTCGACTGTGCCTTCTAGTTGCCAGCCATCTGTTGTTTGCCCCTCCCCCGTGCCTTCCTTG |
| ACCCTGGAAGGTGCCACTCCCACTGTCCTTTCCTAATAAAATGAGGAAATTGCATCGCATTGT |

| Fig 26 cont'd |
|---|
| Vector ID (length between ITRs) & Sequence Between ITRs |
| CTGAGTAGGTGTCATTCTATTCTGGGGGGTGGGGTGGGGCAGGACAGCAAGGGGGAGGATT GGGAAGACAATAGCAGGCATGAGATCTCACGTGCGGACCGAGCGGCCGC (SEQ ID NO: 216) |
| CN2128 (1716) |
| GCGGCCGCACGCGTATCTTTTGAAAAAGGAAGAAAGAAGCTTTTGGGTTCTTTAGGAACCAG ACTCAGGGCAGTAGTGGCTGTGATTATCAGAGACACCTCCCCGACCCCCAATTCTAGAGTCC CCTCCTCCCAGAGTGGCATTAGCTTCTGTCCCATGACTACTATCTGGCTTCCCCTTTCTCTTG CACCCAGGGTGCTACAGGGCGTGACATACAGTGGGGGGTGGGCAGGGGGGGGAGGTTTCC TGCATCTGGCTCTTGCCTAAGGGCTCCAACCTCAGGTTCCTCCTTCTCCAGTTCTCGATCAG GCTCCCACTGGGGACTAAAATAGTCCCAACCTCCTCTCCCATGATCTCCCCTCTGTCCTGGC TGAGCTCGGGCTGGGCATAAAAGTCAGGGCAGAGCCATCTATTGCTTACATTTGCTTCTGGG ATCCAGATCTTTCGAAGCTAGCGCTACCGGTCGCCACCATGGTGAGCAAGGGCGAGGAGCT GTTCACCGGGGTGGTGCCCATCCTGGTCGAGCTGGACGGCGACGTAAACGGCCACAAGTTC AGCGTGTCCGGCGAGGGCGAGGGCGATGCCACCTACGGCAAGCTGACCCTGAAGCTGATC TGCACCACCGGCAAGCTGCCCGTGCCCTGGCCCACCCTCGTGACCACCCTGGGCTACGGC GTGCAGTGCTTCGCCCGCTACCCCGACCACATGAAGCAGCACGACTTCTTCAAGTCCGCCAT GCCCGAAGGCTACGTCCAGGAGCGCACCATCTTCTTCAAGGACGACGGCAACTACAAGACC CGCGCCGAGGTGAAGTTCGAGGGCGACACCCTGGTGAACCGCATCGAGCTGAAGGGCATC GACTTCAAGGAGGACGGCAACATCCTGGGGCACAAGCTGGAGTACAACTACAACAGCCACA ACGTCTATATCACCGCCGACAAGCAGAAGAACGGCATCAAGGCCAACTTCAAGATCCGCCAC AACATCGAGGACGGCGGCGTGCAGCTCGCCGACCACTACCAGCAGAACACCCCCATCGGC GACGGCCCCGTGCTGCTGCCCGACAACCACTACCTGAGCTACCAGTCCAAGCTGAGCAAAG ACCCCAACGAGAAGCGCGATCACATGGTCCTGCTGGAGTTCGTGACCGCCGCCGGGATCAC TCTCGGCATGGACGAGCTGTACAAGTAAGTCGACGGCGCGCCGCGGCCGCGAATTCGATAT CATAATCAACCTCTGGATTACAAAATTTGTGAAAGATTGACTGGTATTCTTAACTATGTTGCTC CTTTTACGCTATGTGGATACGCTGCTTTAATGCCTTTGTATCATGCTATTGCTTCCCGTATGGC TTTCATTTTCTCCTCCTTGTATAAATCCTGGTTAGTTCTTGCCACGGCGGAACTCATCGCCGC CTGCCTTGCCCGCTGCTGGACAGGGGCTCGGCTGTTGGGCACTGACAATTCCGTGGCTCGA GAGATCTTCGACTGTGCCTTCTAGTTGCCAGCCATCTGTTGTTTGCCCCTCCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCGC (SEQ ID NO: 217) |
| CN2129 (1760) |
| GCGGCCGCACGCGTCAGTGTCCACCTCTGCCACAAGAGTACAGCTTAAGCCTCAGCAGAGC CAGTCCGAGCAATTAAAGGGGCAGGGCCCTCACAGCCAGAGGGTGGGCCGGAAAGGCTGG GAGATAGCAGTTCTGAGGAAGCAAACCCACCCTCTCTCTCTTTCCACATCACGCGGACCTGG CTGACGTGGCCCAGGAAGAGGGGACAACCCGGGCCCTGTGGTTGAAATTCTATTTATACTGA CTGTTGCAAGCCTTTCCTGCTGGCGACAAGGACGTCACTGGGCACTGACCTCACCAGAATCG CTGACGCATCTTCCCTCACGCTTTGCCTGGATGGTAGTGAGGCAGGCCTCTCATCCTCTGGG CCACTCCCACTGTCCCTCTGCGTACAGTACCCTCCACTCCTGTCCCCGAGCTCGGGCTGGG CATAAAAGTCAGGGCAGAGCCATCTATTGCTTACATTTGCTTCTGGGATCCAGATCTTTCGAA GCTAGCGCTACCGGTCGCCACCATGGTGAGCAAGGGCGAGGAGCTGTTCACCGGGGTGGT GCCCATCCTGGTCGAGCTGGACGGCGACGTAAACGGCCACAAGTTCAGCGTGTCCGGCGA GGGCGAGGGCGATGCCACCTACGGCAAGCTGACCCTGAAGCTGATCTGCACCACCGGCAA GCTGCCCGTGCCCTGGCCCACCCTCGTGACCACCCTGGGCTACGGCGTGCAGTGCTTCGC CCGCTACCCCGACCACATGAAGCAGCACGACTTCTTCAAGTCCGCCATGCCCGAAGGCTAC GTCCAGGAGCGCACCATCTTCTTCAAGGACGACGGCAACTACAAGACCCGCGCCGAGGTGA AGTTCGAGGGCGACACCCTGGTGAACCGCATCGAGCTGAAGGGCATCGACTTCAAGGAGGA CGGCAACATCCTGGGGCACAAGCTGGAGTACAACTACAACAGCCACAACGTCTATATCACCG |

| Fig 26 cont'd |
| --- |
| Vector ID (length between ITRs) & Sequence Between ITRs |
| CCGACAAGCAGAAGAACGGCATCAAGGCCAACTTCAAGATCCGCCACAACATCGAGGACGG CGGCGTGCAGCTCGCCGACCACTACCAGCAGAACACCCCCATCGGCGACGGCCCCGTGCT GCTGCCCGACAACCACTACCTGAGCTACCAGTCCAAGCTGAGCAAAGACCCCAACGAGAAG CGCGATCACATGGTCCTGCTGGAGTTCGTGACCGCCGCCGGGATCACTCTCGGCATGGACG AGCTGTACAAGTAAGTCGACGGCGCGCCGCGGCCGCGAATTCGATATCATAATCAACCTCTG GATTACAAAATTTGTGAAAGATTGACTGGTATTCTTAACTATGTTGCTCCTTTTACGCTATGTG GATACGCTGCTTTAATGCCTTTGTATCATGCTATTGCTTCCCGTATGGCTTTCATTTTCTCCTC CTTGTATAAATCCTGGTTAGTTCTTGCCACGGCGGAACTCATCGCCGCCTGCCTTGCCCGCT GCTGGACAGGGGCTCGGCTGTTGGGCACTGACAATTCCGTGGCTCGAGAGATCTTCGACTG TGCCTTCTAGTTGCCAGCCATCTGTTGTTTGCCCCTCCCCCGTGCCTTCCTTGACCCTGGAA GGTGCCACTCCCACTGTCCTTTCCTAATAAAATGAGGAAATTGCATCGCATTGTCTGAGTAGG TGTCATTCTATTCTGGGGGGTGGGGTGGGGCAGGACAGCAAGGGGGAGGATTGGGAAGAC AATAGCAGGCATGAGATCTCACGTGCGGACCGAGCGGCCGC (SEQ ID NO: 218) |
| CN2130 (1977) GCGGCCGCACGCGTAAACGCATTTGTGGGAGGGGGAGGCACAAATATCCCACTGAGGAGA GAGTAGTTTCAGGGGTTCCAGAGGTTCAAAGGGGCTCCAAGGAGCTCCGAGGGGCTGCAGGG CAGAAAGCAGAACTAAGGACCGGTCCGTGAAGGTCCTCTTCCCAGGAGGAAACTGTAGCCC CACAATGCCTAGCCTCACAGGAAACCACGTGATGGAAAAAACACAAAACTCCTTCTGGGGAG AGAGTGAGAAGTGAGGTTGTGAGGTTTCTTCAGCTCGGGGGGGTGGGGGGGAGAGCATTTTC CAACCGCAAGGATTGGGGGGGGGGGTGGAGTGGGGCTCAGTCCTCTTGGTCCTTCTCAACTC TGTCCAGAGGACACCATAGCTCAAGGCCTTCAGAGGTTCCTACCCCAACCCAGGCCTCCTG GGCCATCCTAGCCCACCTCAGGAACAGGCCAGAGACCCCAAGCAATGTGAGGGGGCTCAGC TCCTTCCCTCAGGGACAGGATGAGGAAGTCTCCATGCAAATGTGAACAGACCACAGGCAGA GAGTTCACTATTGAGGGGACAAATGCAAATTTCCCAGAAGAGGAGGGGGCAAAGAGAGGAGC CATTGGGTCATGGCTTCCACACAGAGCTCGGGCTGGGCATAAAAGTCAGGGCAGAGCCATC TATTGCTTACATTTGCTTCTGGGATCCAGATCTTTCGAAGCTAGCGCTACCGGTCGCCACCAT GGTGAGCAAGGGCGAGGAGCTGTTCACCGGGGTGGTGCCCATCCTGGTCGAGCTGGACGG CGACGTAAACGGCCACAAGTTCAGCGTGTCCGGCGAGGGCGAGGGCGATGCCACCTACGG CAAGCTGACCCTGAAGCTGATCTGCACCACCGGCAAGCTGCCCGTGCCCTGGCCCACCCTC GTGACCACCCTGGGCTACGGCGTGCAGTGCTTCGCCCGCTACCCCGACCACATGAAGCAGC ACGACTTCTTCAAGTCCGCCATGCCCGAAGGCTACGTCCAGGAGCGCACCATCTTCTTCAAG GACGACGGCAACTACAAGACCCGCGCCGAGGTGAAGTTCGAGGGCGACACCCTGGTGAAC CGCATCGAGCTGAAGGGCATCGACTTCAAGGAGGACGGCAACATCCTGGGGCACAAGCTGG AGTACAACTACAACAGCCACAACGTCTATATCACCGCCGACAAGCAGAAGAACGGCATCAAG GCCAACTTCAAGATCCGCCACAACATCGAGGACGGCGGCGTGCAGCTCGCCGACCACTACC AGCAGAACACCCCCATCGGCGACGGCCCCGTGCTGCTGCCCGACAACCACTACCTGAGCTA CCAGTCCAAGCTGAGCAAAGACCCCAACGAGAAGCGCGATCACATGGTCCTGCTGGAGTTC GTGACCGCCGCCGGGATCACTCTCGGCATGGACGAGCTGTACAAGTAAGTCGACGGCGCG CCGCGGCCGCGAATTCGATATCATAATCAACCTCTGGATTACAAAATTTGTGAAAGATTGACT GGTATTCTTAACTATGTTGCTCCTTTTACGCTATGTGGATACGCTGCTTTAATGCCTTTGTATC ATGCTATTGCTTCCCGTATGGCTTTCATTTTCTCCTCCTTGTATAAATCCTGGTTAGTTCTTGC CACGGCGGAACTCATCGCCGCCTGCCTTGCCCGCTGCTGGACAGGGGCTCGGCTGTTGGG CACTGACAATTCCGTGGCTCGAGAGATCTTCGACTGTGCCTTCTAGTTGCCAGCCATCTGTT GTTTGCCCCTCCCCCGTGCCTTCCTTGACCCTGGAAGGTGCCACTCCCACTGTCCTTTCCTA ATAAAATGAGGAAATTGCATCGCATTGTCTGAGTAGGTGTCATTCTATTCTGGGGGGTGGGG TGGGGCAGGACAGCAAGGGGGAGGATTGGGAAGACAATAGCAGGCATGAGATCTCACGTG CGGACCGAGCGGCCGC (SEQ ID NO: 219) |
| CN2131 (1755) |

| Fig 26 cont'd |
| :--- |
| Vector ID (length between ITRs) & Sequence Between ITRs |
| GCGGCCGCACGCGTAGTGTGGCAGAGTGTGTGGCCTGGGGGAGAGCAGAAGGCTTGGAGG<br>AAGGGATATGCAGACACCCAGCAGGGCAGGGCTGGATTATGGACTTTGTGATGACAGCAGA<br>TTGAAAAGAGAGAGCTCTGGTGTCTTGAAAAGAGGAACTGCTCTATTTGGGTAGCTTCCTGG<br>GTGTAAGGGAAAAGCAATGTCAAAAGTTCAGGCCTGGGGCGCCTTCCAGACCCAATGCCACT<br>AACAGGGATAGGGCGGGGGTGGCAGGAAGGAGACAGACTTGAGCGTGCTCTGCCTCAGTGG<br>ACTATACAATCTGTTTCCTTCACACATGCACAAAGACTGATGGGAAATCGAGTGTTCACACAT<br>AGAACGCCACCGGCCTAACCAGCCCTGGGAGGGCACACAGGTCGAGCTCGGGCTGGGCAT<br>AAAAGTCAGGGCAGAGCCATCTATTGCTTACATTTGCTTCTGGGATCCAGATCTTTCGAAGCT<br>AGCGCTACCGGTCGCCACCATGGTGAGCAAGGGCGAGGAGCTGTTCACCGGGGTGGTGCC<br>CATCCTGGTCGAGCTGGACGGCGACGTAAACGGCCACAAGTTCAGCGTGTCCGGCGAGGG<br>CGAGGGCGATGCCACCTACGGCAAGCTGACCCTGAAGCTGATCTGCACCACCGGCAAGCTG<br>CCCGTGCCCTGGCCCACCCTCGTGACCACCCTGGGCTACGGCGTGCAGTGCTTCGCCCGCT<br>ACCCCGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGAAGTTC<br>GAGGGCGACACCCTGGTGAACCGCATCGAGCTGAAGGGCATCGACTTCAAGGAGGACGGC<br>AACATCCTGGGGCACAAGCTGGAGTACAACTACAACAGCCACAACGTCTATATCACCGCCGA<br>CAAGCAGAAGAACGGCATCAAGGCCAACTTCAAGATCCGCCACAACATCGAGGACGGCGGC<br>GTGCAGCTCGCCGACCACTACCAGCAGAACACCCCCATCGGCGACGGCCCCGTGCTGCTG<br>CCCGACAACCACTACCTGAGCTACCAGTCCAAGCTGAGCAAAGACCCCAACGAGAAGCGCG<br>ATCACATGGTCCTGCTGGAGTTCGTGACCGCCGCCGGGATCACTCTCGGCATGGACGAGCT<br>GTACAAGTAAGTCGACGGCGCGCCGCGGCCGCGAATTCGATATCATAATCAACCTCTGGATT<br>ACAAAATTTGTGAAAGATTGACTGGTATTCTTAACTATGTTGCTCCTTTTACGCTATGTGGATA<br>CGCTGCTTTAATGCCTTTGTATCATGCTATTGCTTCCCGTATGGCTTTCATTTTCTCCTCCTTG<br>TATAAATCCTGGTTAGTTCTTGCCACGGCGGAACTCATCGCCGCCTGCCTTGCCCGCTGCTG<br>GACAGGGGCTCGGCTGTTGGGCACTGACAATTCCGTGGCTCGAGAGATCTTCGACTGTGCC<br>TTCTAGTTGCCAGCCATCTGTTGTTTGCCCCTCCCCCGTGCCTTCCTTGACCCTGGAAGGTG<br>CCACTCCCACTGTCCTTTCCTAATAAAATGAGGAAATTGCATCGCATTGTCTGAGTAGGTGTC<br>ATTCTATTCTGGGGGGTGGGGTGGGGCAGGACAGCAAGGGGGAGGATTGGGAAGACAATA<br>GCAGGCATGAGATCTCACGTGCGGACCGAGCGGCCGC (SEQ ID NO: 220) |
| CN2132 (1664)<br>GCGGCCGCACGCGTTGGCAAGGGTCAGACAGAGCTACAGGTTGGAACACACCAGCTACCTT<br>CACACCTGAGCCCTAGCATGGCTCACACTGGGGGGTGCAAGGACACTCTCTTCCTCAACCTCC<br>TGCTGGTAAGCTAAGCCTGCTTCCTCTTCTCTTGCTCACAGCCAAGCAGTCCAAACCACAATG<br>GTGTCACTGTCAGCTATGACATCACAAAGTACCGTGGTGGAAAAAGATGTGTGTAGGTATCA<br>GAGTGGTAGGTCCCAGAGCTGCAGAGCCCCTGTCCTACATAAGAGGTGGGTCCCAAACCCC<br>AAAGCCCCTGCGAGCTCGGGCTGGGCATAAAAGTCAGGGCAGAGCCATCTATTGCTTACATT<br>TGCTTCTGGGATCCAGATCTTTCGAAGCTAGCGCTACCGGTCGCCACCATGGTGAGCAAGG<br>GCGAGGAGCTGTTCACCGGGGTGGTGCCCATCCTGGTCGAGCTGGACGGCGACGTAAACG<br>GCCACAAGTTCAGCGTGTCCGGCGAGGGCGAGGGCGATGCCACCTACGGCAAGCTGACCC<br>TGAAGCTGATCTGCACCACCGGCAAGCTGCCCGTGCCCTGGCCCACCCTCGTGACCACCCT<br>GGGCTACGGCGTGCAGTGCTTCGCCCGCTACCCCGACCACATGAAGCAGCACGACTTCTTC<br>AAGTCCGCCATGCCCGAAGGCTACGTCCAGGAGCGCACCATCTTCTTCAAGGACGACGGCA<br>ACTACAAGACCCGCGCCGAGGTGAAGTTCGAGGGCGACACCCTGGTGAACCGCATCGAGCT<br>GAAGGGCATCGACTTCAAGGAGGACGGCAACATCCTGGGGCACAAGCTGGAGTACAACTAC<br>AACAGCCACAACGTCTATATCACCGCCGACAAGCAGAAGAACGGCATCAAGGCCAACTTCAA<br>GATCCGCCACAACATCGAGGACGGCGGCGTGCAGCTCGCCGACCACTACCAGCAGAACACC<br>CCCATCGGCGACGGCCCCGTGCTGCTGCCCGACAACCACTACCTGAGCTACCAGTCCAAGC<br>TGAGCAAAGACCCCAACGAGAAGCGCGATCACATGGTCCTGCTGGAGTTCGTGACCGCCGC<br>CGGGATCACTCTCGGCATGGACGAGCTGTACAAGTAAGTCGACGGCGCGCCGCGGCCGCG |

| Fig 26 cont'd |
|---|
| Vector ID (length between ITRs) & Sequence Between ITRs |
| AATTCGATATCATAATCAACCTCTGGATTACAAAATTTGTGAAAGATTGACTGGTATTCTTAAC TATGTTGCTCCTTTTACGCTATGTGGATACGCTGCTTTAATGCCTTTGTATCATGCTATTGCTT CCCGTATGGCTTTCATTTTCTCCTCCTTGTATAAATCCTGGTTAGTTCTTGCCACGGCGGAAC TCATCGCCGCCTGCCTTGCCCGCTGCTGGACAGGGGCTCGGCTGTTGGGCACTGACAATTC CGTGGCTCGAGAGATCTTCGACTGTGCCTTCTAGTTGCCAGCCATCTGTTGTTTGCCCCTCC CCCGTGCCTTCCTTGACCCTGGAAGGTGCCACTCCCACTGTCCTTTCCTAATAAAATGAGGA AATTGCATCGCATTGTCTGAGTAGGTGTCATTCTATTCTGGGGGGTGGGGTGGGGCAGGACA GCAAGGGGGAGGATTGGGAAGACAATAGCAGGCATGAGATCTCACGTGCGGACCGAGCGG CCGC (SEQ ID NO: 221) |
| CN2133 (1712) GCGGCCGCACGCGTTGGAGTGGTCATGTCCTCTTTTTATATAAGTAAAAATTATTCTTCTCAA CAGATAATTTGCATTGTTTAGGGCTTCAGAATAGGGAAGTAGTTATGCTAAAATCAGAAGAGT GAAAGAGCCAAGCAGGCTGAGAGCCCCCTTGAAACCCCCCACCCCATGCTATGCCTCCTCT GAGGAAGCAGCAGAAAGCCCAGCAAAATTTCAGGTTCCTCCTTTGGGGAAAAGAGAAGTTGA CCTCAGTAGTTTCTCTTGAAAGTTACTTATGTTGTGCTGCAGCTTGCATCACTCTGGATACAG GATGGAGTTCTTTCAGTCTTGGAGTTCTTTCAGTCTTGGAGTTCTTTCTGTTCTCTGAGCTCG GGCTGGGCATAAAAGTCAGGGCAGAGCCATCTATTGCTTACATTTGCTTCTGGGATCCAGAT CTTTCGAAGCTAGCGCTACCGGTCGCCACCATGGTGAGCAAGGGCGAGGAGCTGTTCACCG GGGTGGTGCCCATCCTGGTCGAGCTGGACGGCGACGTAAACGGCCACAAGTTCAGCGTGTC CGGCGAGGGCGAGGGCGATGCCACCTACGGCAAGCTGACCCTGAAGCTGATCTGCACCAC CGGCAAGCTGCCCGTGCCCTGGCCCACCCTCGTGACCACCCTGGGCTACGGCGTGCAGTG CTTCGCCCGCTACCCCGACCACATGAAGCAGCACGACTTCTTCAAGTCCGCCATGCCCGAA GGCTACGTCCAGGAGCGCACCATCTTCTTCAAGGACGACGGCAACTACAAGACCCGCGCCG AGGTGAAGTTCGAGGGCGACACCCTGGTGAACCGCATCGAGCTGAAGGGCATCGACTTCAA GGAGGACGGCAACATCCTGGGGCACAAGCTGGAGTACAACTACAACAGCCACAACGTCTAT ATCACCGCCGACAAGCAGAAGAACGGCATCAAGGCCAACTTCAAGATCCGCCACAACATCGA GGACGGCGGCGTGCAGCTCGCCGACCACTACCAGCAGAACACCCCCATCGGCGACGGCCC CGTGCTGCTGCCCGACAACCACTACCTGAGCTACCAGTCCAAGCTGAGCAAAGACCCCAAC GAGAAGCGCGATCACATGGTCCTGCTGGAGTTCGTGACCGCCGCCGGGATCACTCTCGGCA TGGACGAGCTGTACAAGTAAGTCGACGGCGCGCCGCGGCCGCGAATTCGATATCATAATCA ACCTCTGGATTACAAAATTTGTGAAAGATTGACTGGTATTCTTAACTATGTTGCTCCTTTTACG CTATGTGGATACGCTGCTTTAATGCCTTTGTATCATGCTATTGCTTCCCGTATGGCTTTCATTT TCTCCTCCTTGTATAAATCCTGGTTAGTTCTTGCCACGGCGGAACTCATCGCCGCCTGCCTTG CCCGCTGCTGGACAGGGGCTCGGCTGTTGGGCACTGACAATTCCGTGGCTCGAGAGATCTT CGACTGTGCCTTCTAGTTGCCAGCCATCTGTTGTTTGCCCCTCCCCCGTGCCTTCCTTGACC CTGGAAGGTGCCACTCCCACTGTCCTTTCCTAATAAAATGAGGAAATTGCATCGCATTGTCTG AGTAGGTGTCATTCTATTCTGGGGGGTGGGGTGGGGCAGGACAGCAAGGGGGAGGATTGG GAAGACAATAGCAGGCATGAGATCTCACGTGCGGACCGAGCGGCCGC (SEQ ID NO: 222) |
| CN2134 (1751) GCGGCCGCACGCGTCTGGAGCCATTGGGGAAGGGCAAGCCTGGGAGCCAGGAAGCCACCT GCCCAGGGCATGTGAGATGGCCTCTTCAGTCCCCCCCACCCCGCCCCCCTCCCGCCAATAC CCAGCCTTGTCGCTGGTTTCCTGTCAGTCTGCACTCCCCAGGGGAGGGGAGGGGTGGCTAAT CTCTGATGCGTTGTGGAGGCGGGCTCCAAGACCGTTGGGCGCCCTGAGATCCGACCCACGT GGCCTCGGGGTTATAAGCCCTACCCACCCTGAAGGGAACCCCACTTTGGATCCAGCTCTTCT CAGCTCTGCAGCATCAGGTAAGACCTAAATCTTCACTCTGGCCTCAACCAGGGCTCTTTAATT CTGGGCCCAAGGCTCAGAGAAGAGCTTGGGGTGCAGGTTGAGCTCGGGCTGGGCATAAAA GTCAGGGCAGAGCCATCTATTGCTTACATTTGCTTCTGGGATCCAGATCTTTCGAAGCTAGC GCTACCGGTCGCCACCATGGTGAGCAAGGGCGAGGAGCTGTTCACCGGGGTGGTGCCCAT CCTGGTCGAGCTGGACGGCGACGTAAACGGCCACAAGTTCAGCGTGTCCGGCGAGGGCGA |

| Fig 26 cont'd |
| --- |
| Vector ID (length between ITRs) & Sequence Between ITRs |

GGGCGATGCCACCTACGGCAAGCTGACCCTGAAGCTGATCTGCACCACCGGCAAGCTGCCC
GTGCCCTGGCCCACCCTCGTGACCACCCTGGGCTACGGCGTGCAGTGCTTCGCCCGCTACC
CCGACCACATGAAGCAGCACGACTTCTTCAAGTCCGCCATGCCCGAAGGCTACGTCCAGGA
GCGCACCATCTTCTTCAAGGACGACGGCAACTACAAGACCCGCGCCGAGGTGAAGTTCGAG
GGCGACACCCTGGTGAACCGCATCGAGCTGAAGGGCATCGACTTCAAGGAGGACGGCAACA
TCCTGGGGCACAAGCTGGAGTACAACTACAACAGCCACAACGTCTATATCACCGCCGACAAG
CAGAAGAACGGCATCAAGGCCAACTTCAAGATCCGCCACAACATCGAGGACGGCGGCGTGC
AGCTCGCCGACCACTACCAGCAGAACACCCCCATCGGCGACGGCCCCGTGCTGCTGCCCG
ACAACCACTACCTGAGCTACCAGTCCAAGCTGAGCAAAGACCCCAACGAGAAGCGCGATCA
CATGGTCCTGCTGGAGTTCGTGACCGCCGCCGGGATCACTCTCGGCATGGACGAGCTGTAC
AAGTAAGTCGACGGCGCGCCGCGGCCGCGAATTCGATATCATAATCAACCTCTGGATTACAA
AATTTGTGAAAGATTGACTGGTATTCTTAACTATGTTGCTCCTTTTACGCTATGTGGATACGCT
GCTTTAATGCCTTTGTATCATGCTATTGCTTCCCGTATGGCTTTCATTTTCTCCTCCTTGTATA
AATCCTGGTTAGTTCTTGCCACGGCGGAACTCATCGCCGCCTGCCTTGCCCGCTGCTGGACA
GGGGCTCGGCTGTTGGGCACTGACAATTCCGTGGCTCGAGAGATCTTCGACTGTGCCTTCTA
GTTGCCAGCCATCTGTTGTTTGCCCCTCCCCCGTGCCTTCCTTGACCCTGGAAGGTGCCACT
CCCACTGTCCTTTCCTAATAAAATGAGGAAATTGCATCGCATTGTCTGAGTAGGTGTCATTCT
ATTCTGGGGGGTGGGGTGGGGCAGGACAGCAAGGGGGAGGATTGGGAAGACAATAGCAGG
CATGAGATCTCACGTGCGGACCGAGCGGCCGC (SEQ ID NO: 223)

CN2141 (1650)
GCGGCCGCACGCGTCTCCCTGCTCCCCAACCGCAGCCTGAGGTGTGAGAATTCTAGATAGG
GCCACGACAGTGTGAGCACATGAAAGATTACCAGGAAGAGGTTGAAACCTGGCTCCTGGGA
GAGAGAGGGGGTGTGAGGCCTTGGCAGGAAGCCCAGTGCTTGGCTGCCCTGGTTTCCTGGG
GCCCAGGCATGCGTGGTCACAGTCCACAGCCTAGGGCTGGGCCAGGAGGACATGCCTGCC
AGAGTCCCGAGGGTGAGGGGAAGGAAGGGACAGGAGGCGCTCAGCTGGGGCAGGGAGAA
ACCAAGAGCTCGGGCTGGGCATAAAAGTCAGGGCAGAGCCATCTATTGCTTACATTTGCTTC
TGGGATCCAGATCTTTCGAAGCTAGCGCTACCGGTCGCCACCATGGTGAGCAAGGGCGAGG
AGCTGTTCACCGGGGTGGTGCCCATCCTGGTCGAGCTGGACGGCGACGTAAACGGCCACAA
GTTCAGCGTGTCCGGCGAGGGCGAGGGCGATGCCCACCTACGGCAAGCTGACCCTGAAGCT
GATCTGCACCACCGGCAAGCTGCCCGTGCCCTGGCCCACCCTCGTGACCACCCTGGGCTAC
GGCGTGCAGTGCTTCGCCCGCTACCCCGACCACATGAAGCAGCACGACTTCTTCAAGTCCG
CCATGCCCGAAGGCTACGTCCAGGAGCGCACCATCTTCTTCAAGGACGACGGCAACTACAA
GACCCGCGCCGAGGTGAAGTTCGAGGGCGACACCCTGGTGAACCGCATCGAGCTGAAGGG
CATCGACTTCAAGGAGGACGGCAACATCCTGGGGCACAAGCTGGAGTACAACTACAACAGC
CACAACGTCTATATCACCGCCGACAAGCAGAAGAACGGCATCAAGGCCAACTTCAAGATCCG
CCACAACATCGAGGACGGCGGCGTGCAGCTCGCCGACCACTACCAGCAGAACACCCCCATC
GGCGACGGCCCCGTGCTGCTGCCCGACAACCACTACCTGAGCTACCAGTCCAAGCTGAGCA
AAGACCCCAACGAGAAGCGCGATCACATGGTCCTGCTGGAGTTCGTGACCGCCGCCGGGAT
CACTCTCGGCATGGACGAGCTGTACAAGTAAGTCGACGGCGCGCCGCGGCCGCGAATTCGA
TATCATAATCAACCTCTGGATTACAAAATTTGTGAAAGATTGACTGGTATTCTTAACTATGTTG
CTCCTTTTACGCTATGTGGATACGCTGCTTTAATGCCTTTGTATCATGCTATTGCTTCCCGTAT
GGCTTTCATTTTCTCCTCCTTGTATAAATCCTGGTTAGTTCTTGCCACGGCGGAACTCATCGC
CGCCTGCCTTGCCCGCTGCTGGACAGGGGCTCGGCTGTTGGGCACTGACAATTCCGTGGCT
CGAGAGATCTTCGACTGTGCCTTCTAGTTGCCAGCCATCTGTTGTTTGCCCCTCCCCCGTGC
CTTCCTTGACCCTGGAAGGTGCCACTCCCACTGTCCTTTCCTAATAAAATGAGGAAATTGCAT
CGCATTGTCTGAGTAGGTGTCATTCTATTCTGGGGGGTGGGGTGGGGCAGGACAGCAAGGG
GGAGGATTGGGAAGACAATAGCAGGCATGAGATCTCACGTGCGGACCGAGCGGCCGC (SEQ
ID NO: 224)

| Fig 26 cont'd |
|---|
| Vector ID (length between ITRs) & Sequence Between ITRs |
| CN2142 (1621)<br>GCGGCCGCACGCGTGAACTGAACATGATGTGAGATGTGTAACTTTCATTTATTCACTCATGTG<br>CCAGGCACCATGCTGACATTACATGTGAAAAGTTTCCAAGGTTTTCTTGTTACGTCTACAATTA<br>CTGCTAAGTTTCCCGTAAGTAATTTGGGGGACTGGAAACGAGGGCAAAATTACATGAAGGGC<br>TTAGAAAACTGCATCAATTCTTTTTGGATGTGTCAGGGAGATGGGGGTAGTCTTTCTCCCTGC<br>TAATCAAGACCCACTAGAGCACCGCGAGCTCGGGCTGGGCATAAAAGTCAGGGCAGAGCCA<br>TCTATTGCTTACATTTGCTTCTGGGATCCAGATCTTTCGAAGCTAGCGCTACCGGTCGCCACC<br>ATGGTGAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCACCTAC<br>GGCAAGCTGACCCTGAAGCTGATCTGCACCACCGGCAAGCTGCCCGTGCCCTGGCCCACCC<br>TCGTGACCACCCTGGGCTACGGCGTGCAGTGCTTCGCCCGCTACCCCGACCACATGAAGCA<br>GCACGACTTCTTCAAGTCCGCCATGCCCGAAGGCTACGTCCAGGAGCGCACCATCTTCTTCA<br>AGGACGACGGCAACTACAAGACCCGCGCCGAGGTGAAGTTCGAGGGCGACACCCTGGTGA<br>ACCGCATCGAGCTGAAGGGCATCGACTTCAAGGAGGACGGCAACATCCTGGGGCACAAGCT<br>GGAGTACAACTACAACAGCCACAACGTCTATATCACCGCCGACAAGCAGAAGAACGGCATCA<br>AGGCCAACTTCAAGATCCGCCACAACATCGAGGACGGCGGCGTGCAGCTCGCCGACCACTA<br>CCAGCAGAACACCCCCATCGGCGACGGCCCCGTGCTGCTGCCCGACAACCACTACCTGAGC<br>TACCAGTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAGTAAGTCGACGGCGC<br>GCCGCGGCCGCGAATTCGATATCATAATCAACCTCTGGATTACAAAATTTGTGAAAGATTGAC<br>TGGTATTCTTAACTATGTTGCTCCTTTTACGCTATGTGGATACGCTGCTTTAATGCCTTTGTAT<br>CATGCTATTGCTTCCCGTATGGCTTTCATTTTCTCCTCCTTGTATAAATCCTGGTTAGTTCTTG<br>CCACGGCGGAACTCATCGCCGCCTGCCTTGCCCGCTGCTGGACAGGGGCTCGGCTGTTGG<br>GCACTGACAATTCCGTGGCTCGAGAGATCTTCGACTGTGCCTTCTAGTTGCCAGCCATCTGT<br>TGTTTGCCCCTCCCCCGTGCCTTCCTTGACCCTGGAAGGTGCCACTCCCACTGTCCTTTCCT<br>AATAAAATGAGGAAATTGCATCGCATTGTCTGAGTAGGTGTCATTCTATTCTGGGGGGTGGG<br>GTGGGGCAGGACAGCAAGGGGGAGGATTGGGAAGACAATAGCAGGCATGAGATCTCACGT<br>GCGGACCGAGCGGCCGC (SEQ ID NO: 225) |
| CN2143 (1685)<br>GCGGCCGCACGCGTGGCCACGTTTTGCCTAGGGAAGATGAAGTCTTTGATGATAGCCAACTT<br>AGTGTCAATAAGTGGCTTTCTTTGAGACATATTCAGATGGGAACGTCTTGCTTGCCAATTGCC<br>ATAGAAATCTTAACACACCATGAAGATTGTCCGAGCGCCAAGCCTTCCGTTCTGGACTAAATT<br>ACTTTGAAGTGGCGCAGTACGAGCAGTGGTCAATTTTAACTCTATAGACTGGACAGAGAATG<br>CTGGGAGTGGGAGATTGTGCGTTTTAAAGCAGAAAATAAGAAGGGGAAACTTGTTTTATACAC<br>TCTATACAAGGTTCTGCTCATTGTCAGAGAGCTCGGGCTGGGCATAAAAGTCAGGGCAGAGC<br>CATCTATTGCTTACATTTGCTTCTGGGATCCAGATCTTTCGAAGCTAGCGCTACCGGTCGCCA<br>CCATGGTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGCCACCT<br>ACGGCAAGCTGACCCTGAAGCTGATCTGCACCACCGGCAAGCTGCCCGTGCCCTGGCCCAC<br>CCTCGTGACCACCCTGGGCTACGGCGTGCAGTGCTTCGCCCGCTACCCCGACCACATGAAG<br>CAGCACGACTTCTTCAAGTCCGCCATGCCCGAAGGCTACGTCCAGGAGCGCACCATCTTCTT<br>CAAGGACGACGGCAACTACAAGACCCGCGCCGAGGTGAAGTTCGAGGGCGACACCCTGGT<br>GAACCGCATCGAGCTGAAGGGCATCGACTTCAAGGAGGACGGCAACATCCTGGGGCACAAG<br>CTGGAGTACAACTACAACAGCCACAACGTCTATATCACCGCCGACAAGCAGAAGAACGGCAT<br>CAAGGCCAACTTCAAGATCCGCCACAACATCGAGGACGGCGGCGTGCAGCTCGCCGACCAC<br>TACCAGCAGAACACCCCCATCGGCGACGGCCCCGTGCTGCTGCCCGACAACCACTACCTGA<br>GCTACCAGTCCAAGCTGAGCAAAGACCCCAACGAGAAGCGCGATCACATGGTCCTGCTGGA<br>GTTCGTGACCGCCGCCGGGATCACTCTCGGCATGGACGAGCTGTACAAGTAAGTCGACGGC<br>GCGCCGCGGCCGCGAATTCGATATCATAATCAACCTCTGGATTACAAAATTTGTGAAAGATTG |

| Fig 26 cont'd |
| --- |
| Vector ID (length between ITRs) & Sequence Between ITRs |
| ACTGGTATTCTTAACTATGTTGCTCCTTTTACGCTATGTGGATACGCTGCTTTAATGCCTTTGT ATCATGCTATTGCTTCCCGTATGGCTTTCATTTTCTCCTCCTTGTATAAATCCTGGTTAGTTCT TGCCACGGCGGAACTCATCGCCGCCTGCCTTGCCCGCTGCTGGACAGGGGCTCGGCTGTT GGGCACTGACAATTCCGTGGCTCGAGAGATCTTCGACTGTGCCTTCTAGTTGCCAGCCATCT GTTGTTTGCCCCTCCCCCGTGCCTTCCTTGACCCTGGAAGGTGCCACTCCCACTGTCCTTTC CTAATAAAATGAGGAAATTGCATCGCATTGTCTGAGTAGGTGTCATTCTATTCTGGGGGGTGG GGTGGGGCAGGACAGCAAGGGGGAGGATTGGGAAGACAATAGCAGGCATGAGATCTCACG TGCGGACCGAGCGGCCGC (SEQ ID NO: 226) |
| CN2144 (1913) GCGGCCGCACGCGTGGGGCCATTGAGATTGCTGGATCCTGATTCTTTGAAGCATTTCATTCA TTATGGTAAAGAAGGGTTTAAGTGGCCACCAACAGAGAGACGTGAAGTACATGAAACAATTA GGTTCTCTGTATCTCCAGCAGAATTGGCCCCAGAAGAGGGTCAGGCTTTGCAAAGACACAGA ACATTTTTCCCGCTGGGCTCCTTGGGAAAAGGTCTCAGCATTATGGAGGGTGTCTCTGGCTA TTCACAGCTTGCCAGTGGGAACAGCCAAGAAGGAGAAGAGGTCACATGGCCAGGCCTGCTG CCGGCACAGAATGTTCTGTGCAGCTGATGGCTGGGCAGGGATGAGGTTTGCCCGATCCCCT GCTGAGGCTTCCTATGAAAGGTAGGCCTGAGAGTTGCCAAAACATATTCTGCAACAGGGTCT ATGAAGGTCACCATAAAGCAGGATTCAGACTCCATATTAGTTGGTTATCTCTTCTATACAGAAT GTTATGCCAAGCATTTCTATATATATTCCTTTTGTTTGTTTGTTTTTGTTTTTGTTTTGAGAGGG AGTCTTGCGAGCTCGGGCTGGGCATAAAAGTCAGGGCAGAGCCATCTATTGCTTACATTTGC TTCTGGGATCCAGATCTTTCGAAGCTAGCGCTACCGGTCGCCACCATGGTGAGCAAGGGCG AGGAGCTGTTCACCGGGGTGGTGCCCATCCTGGTCGAGCTGGACGGCGACGTAAACGGCC ACAAGTTCAGCGTGTCCGGCGAGGGCGAGGGCGATGCCACCTACGGCAAGCTGACCCTGA AGCTGATCTGCACCACCGGCAAGCTGCCCGTGCCCTGGCCCACCCTCGTGACCACCCTGGG CTACGGCGTGCAGTGCTTCGCCCGCTACCCCGACCACATGAAGCAGCACGACTTCTTCAAGT CCGCCATGCCCGAAGGCTACGTCCAGGAGCGCACCATCTTCTTCAAGGACGACGGCAACTA CAAGACCCGCGCCGAGGTGAAGTTCGAGGGCGACACCCTGGTGAACCGCATCGAGCTGAA GGGCATCGACTTCAAGGAGGACGGCAACATCCTGGGGCACAAGCTGGAGTACAACTACAAC AGCCACAACGTCTATATCACCGCCGACAAGCAGAAGAACGGCATCAAGGCCAACTTCAAGAT CCGCCACAACATCGAGGACGGCGGCGTGCAGCTCGCCGACCACTACCAGCAGAACACCCC CATCGGCGACGGCCCCGTGCTGCTGCCCGACAACCACTACCTGAGCTACCAGTCCAAGCTG AGCAAAGACCCCAACGAGAAGCGCGATCACATGGTCCTGCTGGAGTTCGTGACCGCCGCCG GGATCACTCTCGGCATGGACGAGCTGTACAAGTAAGTCGACGGCGCGCCGCGGCCGCGAAT TCGATATCATAATCAACCTCTGGATTACAAAATTTGTGAAAGATTGACTGGTATTCTTAACTAT GTTGCTCCTTTTACGCTATGTGGATACGCTGCTTTAATGCCTTTGTATCATGCTATTGCTTCCC GTATGGCTTTCATTTTCTCCTCCTTGTATAAATCCTGGTTAGTTCTTGCCACGGCGGAACTCAT CGCCGCCTGCCTTGCCCGCTGCTGGACAGGGGCTCGGCTGTTGGGCACTGACAATTCCGTG GCTCGAGAGATCTTCGACTGTGCCTTCTAGTTGCCAGCCATCTGTTGTTTGCCCCTCCCCCG TGCCTTCCTTGACCCTGGAAGGTGCCACTCCCACTGTCCTTTCCTAATAAAATGAGGAAATTG CATCGCATTGTCTGAGTAGGTGTCATTCTATTCTGGGGGGTGGGGTGGGGCAGGACAGCAA GGGGGAGGATTGGGAAGACAATAGCAGGCATGAGATCTCACGTGCGGACCGAGCGGCCGC (SEQ ID NO: 227) |
| CN2145 (1841) GCGGCCGCACGCGTGTTATCACAAAGCTTCTAGTCAACCTTAATTTCTACCACCTGAAATTCA GAACCTAAGGCTATTTTACAATCTTTACAAAATTTAAATTATTTTTCTCTTAAAAGCTGGGCAG GTTGGTGGGTTTTCTTGGTTTATTCTTCAGGTTTTTTGTTTTGGTTTGGTTTTTGGTTTTAGTCC TTGAGCTTTGTAAATAAGTTTTCCTGCGCCTGCTTGCCTGTAACTTATTTTTCTGGTCTAATGA CTGTTTTTTAATGAGTTCAGCCTGTGCTTTCTTGTACAAAAAGAAACGTGGGCATGTGAGGAG CATATTAATTAGCTATCAGATGTAGCCTGGTTTTTGAAGTCCAGATCTTCAGGATGTTACCGAA GTGTAAATATAAGCATGACTTTTGCACGTGATTAGTAATTACATCACAGTTAAAGCCTCAGGG |

| Fig 26 cont'd |
|---|
| Vector ID (length between ITRs) & Sequence Between ITRs |
| GACCTTCCACCCCAGAATTCTGCTATCCTCAACCCCTGAATGGCTCTGTCAGAGCTCGGGCT GGGCATAAAAGTCAGGGCAGAGCCATCTATTGCTTACATTTGCTTCTGGGATCCAGATCTTTC GAAGCTAGCGCTACCGGTCGCCACCATGGTGAGCAAGGGCGAGGAGCTGTTCACCGGGGT GGTGCCCATCCTGGTCGAGCTGGACGGCGACGTAAACGGCCACAAGTTCAGCGTGTCCGGC GAGGGCGAGGGCGATGCCACCTACGGCAAGCTGACCCTGAAGCTGATCTGCACCACCGGC AAGCTGCCCGTGCCCTGGCCCACCCTCGTGACCACCCTGGGCTACGGCGTGCAGTGCTTCG CCCGCTACCCCGACCACATGAAGCAGCACGACTTCTTCAAGTCCGCCATGCCCGAAGGCTA CGTCCAGGAGCGCACCATCTTCTTCAAGGACGACGGCAACTACAAGACCCGCGCCGAGGTG AAGTTCGAGGGCGACACCCTGGTGAACCGCATCGAGCTGAAGGGCATCGACTTCAAGGAGG ACGGCAACATCCTGGGGCACAAGCTGGAGTACAACTACAACAGCCACAACGTCTATATCACC GCCGACAAGCAGAAGAACGGCATCAAGGCCAACTTCAAGATCCGCCACAACATCGAGGACG GCGGCGTGCAGCTCGCCGACCACTACCAGCAGAACACCCCCATCGGCGACGGCCCCGTGC TGCTGCCCGACAACCACTACCTGAGCTACCAGTCCAAGCTGAGCAAAGACCCCAACGAGAA GCGCGATCACATGGTCCTGCTGGAGTTCGTGACCGCCGCCGGGATCACTCTCGGCATGGAC GAGCTGTACAAGTAAGTCGACGGCGCGCCGCGGCCGCGAATTCGATATCATAATCAACCTCT GGATTACAAAATTTGTGAAAGATTGACTGGTATTCTTAACTATGTTGCTCCTTTTACGCTATGT GGATACGCTGCTTTAATGCCTTTGTATCATGCTATTGCTTCCCGTATGGCTTTCATTTTCTCCT CCTTGTATAAATCCTGGTTAGTTCTTGCCACGGCGGAACTCATCGCCGCCTGCCTTGCCCGC TGCTGGACAGGGGCTCGGCTGTTGGGCACTGACAATTCCGTGGCTCGAGAGATCTTCGACT GTGCCTTCTAGTTGCCAGCCATCTGTTGTTTGCCCCTCCCCCGTGCCTTCCTTGACCCTGGA AGGTGCCACTCCCACTGTCCTTTCCTAATAAAATGAGGAAATTGCATCGCATTGTCTGAGTAG GTGTCATTCTATTCTGGGGGGTGGGGTGGGGCAGGACAGCAAGGGGGAGGATTGGGAAGA CAATAGCAGGCATGAGATCTCACGTGCGGACCGAGCGGCCGC (SEQ ID NO: 228) |
| CN2146 (1590) GCGGCCGCACGCGTGGGCTTTCTAAACTGGCCTGGAACACTGTTAGTTAATAAACATTCCTT TCAGGGTTGTTCTCTTTGCTTCTGATCTCATTGATGATGATTTGTTGGACAAATAAGGAAGTAA ACAGTGCAGAGTTTTTTGGCTTCTGCTCTATTAAAAACATAGCAGAGAAGGACAAGAAGTTCC TGCCTGCTAAATAGGAAGATCTAGGGAATCAAAAGAGTCTCTGTCAAGCTTCTTGTAGAGCTC GGGCTGGGCATAAAAGTCAGGGCAGAGCCATCTATTGCTTACATTTGCTTCTGGGATCCAGA TCTTTCGAAGCTAGCGCTACCGGTCGCCACCATGGTGAGCAAGGGCGAGGAGCTGTTCACC GGGGTGGTGCCCATCCTGGTCGAGCTGGACGGCGACGTAAACGGCCACAAGTTCAGCGTGT CCGGCGAGGGCGAGGGCGATGCCACCTACGGCAAGCTGACCCTGAAGCTGATCTGCACCA CCGGCAAGCTGCCCGTGCCCTGGCCCACCCTCGTGACCACCCTGGGCTACGGCGTGCAGT GCTTCGCCCGCTACCCCGACCACATGAAGCAGCACGACTTCTTCAAGTCCGCCATGCCCGA AGGCTACGTCCAGGAGCGCACCATCTTCTTCAAGGACGACGGCAACTACAAGACCCGCGCC GAGGTGAAGTTCGAGGGCGACACCCTGGTGAACCGCATCGAGCTGAAGGGCATCGACTTCA AGGAGGACGGCAACATCCTGGGGCACAAGCTGGAGTACAACTACAACAGCCACAACGTCTA TATCACCGCCGACAAGCAGAAGAACGGCATCAAGGCCAACTTCAAGATCCGCCACAACATCG AGGACGGCGGCGTGCAGCTCGCCGACCACTACCAGCAGAACACCCCCATCGGCGACGGCC CCGTGCTGCTGCCCGACAACCACTACCTGAGCTACCAGTCCAAGCTGAGCAAAGACCCCAA CGAGAAGCGCGATCACATGGTCCTGCTGGAGTTCGTGACCGCCGCCGGGATCACTCTCGGC ATGGACGAGCTGTACAAGTAAGTCGACGGCGCGCCGCGGCCGCGAATTCGATATCATAATC AACCTCTGGATTACAAAATTTGTGAAAGATTGACTGGTATTCTTAACTATGTTGCTCCTTTTAC GCTATGTGGATACGCTGCTTTAATGCCTTTGTATCATGCTATTGCTTCCCGTATGGCTTTCATT TTCTCCTCCTTGTATAAATCCTGGTTAGTTCTTGCCACGGCGGAACTCATCGCCGCCTGCCTT GCCCGCTGCTGGACAGGGGCTCGGCTGTTGGGCACTGACAATTCCGTGGCTCGAGAGATCT TCGACTGTGCCTTCTAGTTGCCAGCCATCTGTTGTTTGCCCCTCCCCCGTGCCTTCCTTGAC CCTGGAAGGTGCCACTCCCACTGTCCTTTCCTAATAAAATGAGGAAATTGCATCGCATTGTCT |

| Fig 26 cont'd |
| :--- |
| Vector ID (length between ITRs) & Sequence Between ITRs |
| GAGTAGGTGTCATTCTATTCTGGGGGGTGGGGTGGGGCAGGACAGCAAGGGGGAGGATTG GGAAGACAATAGCAGGCATGAGATCTCACGTGCGGACCGAGCGGCCGC (SEQ ID NO: 229) |
| CN2147 (1873) GCGGCCGCACGCGTCTTTGTTTTCATGGCATATTATTGGGCAAAGATACTATTTATTCGATGC TATGTGTGAGCTGGGTCAGGATTATGACCCTGAGTTATGTTTCTGGGAAAATGTACCCACTTG TCAAAGATGCCGTTGGCTCCTGTGATTAAGGTCAGCCCACAATGAATGTGGGGAGGGCTGG CAGCCTCTCAAATCAGCTCTTGACCATTTCTCAAGCTGGGGCCTGTTGTGCTTGGGGGAAGA GTCTTTGGCAGCTCAGCTCGGGGCTAGCGTTTCCTGACATTTGTTTCGCTGAATGTTAACAAG GTTACTGGAAAAAAGGGTTCTCTCCTAAAATAGGTTTAGGGAAGCACTGGGATATGCGAAGT GAATGAGTTTCTTTAGGGCAGGATCTTGACTCTGCAGGGGGCTTGGAGGCCTTCCCTAGAGT GGGGCTTCCTAACACTGCAGAGCTCTTCCCAGGACGAGGGGCAAGATTGGGACCTACTTTG GAAGGTTGTTTTTGTTTCGGCACCTGCTCTGTGAGCTCGGGCTGGGCATAAAAGTCAGGGCA GAGCCATCTATTGCTTACATTTGCTTCTGGGATCCAGATCTTTCGAAGCTAGCGCTACCGGTC GCCACCATGGTGAGCAAGGGCGAGGAGCTGTTCACCGGGGTGGTGCCCATCCTGGTCGAG CTGGACGGCGACGTAAACGGCCACAAGTTCAGCGTGTCCGGCGAGGGCGAGGGCGATGCC ACCTACGGCAAGCTGACCCTGAAGCTGATCTGCACCACCGGCAAGCTGCCCGTGCCCTGGC CCACCCTCGTGACCACCCTGGGCTACGGCGTGCAGTGCTTCGCCCGCTACCCCGACCACAT GAAGCAGCACGACTTCTTCAAGTCCGCCATGCCCGAAGGCTACGTCCAGGAGCGCACCATC TTCTTCAAGGACGACGGCAACTACAAGACCCGCGCCGAGGTGAAGTTCGAGGGCGACACCC TGGTGAACCGCATCGAGCTGAAGGGCATCGACTTCAAGGAGGACGGCAACATCCTGGGGCA CAAGCTGGAGTACAACTACAACAGCCACAACGTCTATATCACCGCCGACAAGCAGAAGAACG GCATCAAGGCCAACTTCAAGATCCGCCACAACATCGAGGACGGCGGCGTGCAGCTCGCCGA CCACTACCAGCAGAACACCCCCATCGGCGACGGCCCCGTGCTGCTGCCCGACAACCACTAC CTGAGCTACCAGTCCAAGCTGAGCAAAGACCCCAACGAGAAGCGCGATCACATGGTCCTGC TGGAGTTCGTGACCGCCGCCGGGATCACTCTCGGCATGGACGAGCTGTACAAGTAAGTCGA CGGCGCGCCGCGGCCGCGAATTCGATATCATAATCAACCTCTGGATTACAAAATTTGTGAAA GATTGACTGGTATTCTTAACTATGTTGCTCCTTTTACGCTATGTGGATACGCTGCTTTAATGCC TTTGTATCATGCTATTGCTTCCCGTATGGCTTTCATTTTCTCCTCCTTGTATAAATCCTGGTTA GTTCTTGCCACGGCGGAACTCATCGCCGCCTGCCTTGCCCGCTGCTGGACAGGGGCTCGGC TGTTGGGCACTGACAATTCCGTGGCTCGAGAGATCTTCGACTGTGCCTTCTAGTTGCCAGCC ATCTGTTGTTTGCCCCTCCCCCGTGCCTTCCTTGACCCTGGAAGGTGCCACTCCCACTGTCC TTTCCTAATAAAATGAGGAAATTGCATCGCATTGTCTGAGTAGGTGTCATTCTATTCTGGGGG GTGGGGTGGGGCAGGACAGCAAGGGGGAGGATTGGGAAGACAATAGCAGGCATGAGATCT CACGTGCGGACCGAGCGGCCGC (SEQ ID NO: 230) |
| CN2148 (1730) GCGGCCGCACGCGTGAGAAGCCAGGCAGACAGCTGCCCAAAGGGCAGGGGAGCCAGCAGA GCTTCTGAAAATATCATGAGGCTTGGAAGACAAACACTGGAGTTCAGGCCAAGAGGAAATCA AGGGCTTGGGGGACCAAGATCATGGAAAATAAAGAGGCATGGGGAAGTCAGCCTGACAGTC TCTGGTACTCTCCATTAGACATTTGCCAATTCTTTATTGAGCAGTGTCAGGGGTTAAGAAGCT AAGAAAAATTAGCTGAAAAGGAGAAGAGAGTTTTTGGCAGCCTCACAACACTGGGTAAACAA AAACTGGAATTCAGCACTGCCAAGGCAAAGAGGTCATAGTAAACACTCTAGTCTTTTAGTCTT GGACCATTGGCAAGCTGAGCTCGGGCTGGGCATAAAAGTCAGGGCAGAGCCATCTATTGCT TACATTTGCTTCTGGGATCCAGATCTTTCGAAGCTAGCGCTACCGGTCGCCACCATGGTGAG CAAGGGCGAGGAGCTGTTCACCGGGGTGGTGCCCATCCTGGTCGAGCTGGACGGCGACGT AAACGGCCACAAGTTCAGCGTGTCCGGCGAGGGCGAGGGCGATGCCACCTACGGCAAGCT GACCCTGAAGCTGATCTGCACCACCGGCAAGCTGCCCGTGCCCTGGCCCACCCTCGTGACC ACCCTGGGCTACGGCGTGCAGTGCTTCGCCCGCTACCCCGACCACATGAAGCAGCACGACT TCTTCAAGTCCGCCATGCCCGAAGGCTACGTCCAGGAGCGCACCATCTTCTTCAAGGACGAC GGCAACTACAAGACCCGCGCCGAGGTGAAGTTCGAGGGCGACACCCTGGTGAACCGCATC |

| Fig 26 cont'd |
| --- |
| Vector ID (length between ITRs) & Sequence Between ITRs |
| GAGCTGAAGGGCATCGACTTCAAGGAGGACGGCAACATCCTGGGGCACAAGCTGGAGTACA ACTACAACAGCCACAACGTCTATATCACCGCCGACAAGCAGAAGAACGGCATCAAGGCCAAC TTCAAGATCCGCCACAACATCGAGGACGGCGGCGTGCAGCTCGCCGACCACTACCAGCAGA ACACCCCCATCGGCGACGGCCCCGTGCTGCTGCCCGACAACCACTACCTGAGCTACCAGTC CAAGCTGAGCAAAGACCCCAACGAGAAGCGCGATCACATGGTCCTGCTGGAGTTCGTGACC GCCGCCGGGATCACTCTCGGCATGGACGAGCTGTACAAGTAAGTCGACGGCGCGCCGCGG CCGCGAATTCGATATCATAATCAACCTCTGGATTACAAAATTTGTGAAAGATTGACTGGTATTC TTAACTATGTTGCTCCTTTTACGCTATGTGGATACGCTGCTTTAATGCCTTTGTATCATGCTAT TGCTTCCCGTATGGCTTTCATTTTCTCCTCCTTGTATAAATCCTGGTTAGTTCTTGCCACGGC GGAACTCATCGCCGCCTGCCTTGCCCGCTGCTGGACAGGGGCTCGGCTGTTGGGCACTGAC AATTCCGTGGCTCGAGAGATCTTCGACTGTGCCTTCTAGTTGCCAGCCATCTGTTGTTTGCCC CTCCCCCGTGCCTTCCTTGACCCTGGAAGGTGCCACTCCCACTGTCCTTTCCTAATAAAATGA GGAAATTGCATCGCATTGTCTGAGTAGGTGTCATTCTATTCTGGGGGGTGGGGTGGGGCAG GACAGCAAGGGGGAGGATTGGGAAGACAATAGCAGGCATGAGATCTCACGTGCGGACCGA GCGGCCGC (SEQ ID NO: 231) |
| CN2149 (1799) GCGGCCGCACGCGTGACGCAAAGCAGAGTAGCCAACAAAAACCACTTAACTAGGCCCACCT ATACAGTATGACCAAGTTGAGGATAAGCCTCACTAAAATATTTCACCTGGCATGTGTTCAAGT TTTGAGGTTGAATGAGTCTGCTTTTGTTTCTCACTAAGCCTGGAAGAAAGGGAACTTGTTAGG GAGGAGGAGAGGAGAGAAGGGAGGAATGAGTTAAGTCCTTAGCATCTTTAGTGCTTTTTCTT TGCTTCTTTTCAAACAAGCACACCACATTGAATAGCATGTGGAAAATTGGCATTTCCAGTGAA TAGAAATTAACTGGCAAACAACAAAAGGGAAAACAGAGGAATGCTGCTGGATGCTGTTTGAC TTGTCTCATCTTGTCAGAGAAGGAACACCTGTGAATCAAATGATTTAAGATGAATTTACCTACA TGTTTGGTTCCTGTTCAGAGCTCGGGCTGGGCATAAAAGTCAGGGCAGAGCCATCTATTGCT TACATTTGCTTCTGGGATCCAGATCTTTCGAAGCTAGCGCTACCGGTCGCCACCATGGTGAG CAAGGGCGAGGAGCTGTTCACCGGGGTGGTGCCCATCCTGGTCGAGCTGGACGGCGACGT AAACGGCCACAAGTTCAGCGTGTCCGGCGAGGGCGAGGGCGATGCCACCTACGGCAAGCT GACCCTGAAGCTGATCTGCACCACCGGCAAGCTGCCCGTGCCCTGGCCCACCCTCGTGACC ACCCTGGGCTACGGCGTGCAGTGCTTCGCCCGCTACCCCGACCACATGAAGCAGCACGACT TCTTCAAGTCCGCCATGCCCGAAGGCTACGTCCAGGAGCGCACCATCTTCTTCAAGGACGAC GGCAACTACAAGACCCGCGCCGAGGTGAAGTTCGAGGGCGACACCCTGGTGAACCGCATC GAGCTGAAGGGCATCGACTTCAAGGAGGACGGCAACATCCTGGGGCACAAGCTGGAGTACA ACTACAACAGCCACAACGTCTATATCACCGCCGACAAGCAGAAGAACGGCATCAAGGCCAAC TTCAAGATCCGCCACAACATCGAGGACGGCGGCGTGCAGCTCGCCGACCACTACCAGCAGA ACACCCCCATCGGCGACGGCCCCGTGCTGCTGCCCGACAACCACTACCTGAGCTACCAGTC CAAGCTGAGCAAAGACCCCAACGAGAAGCGCGATCACATGGTCCTGCTGGAGTTCGTGACC GCCGCCGGGATCACTCTCGGCATGGACGAGCTGTACAAGTAAGTCGACGGCGCGCCGCGG CCGCGAATTCGATATCATAATCAACCTCTGGATTACAAAATTTGTGAAAGATTGACTGGTATTC TTAACTATGTTGCTCCTTTTACGCTATGTGGATACGCTGCTTTAATGCCTTTGTATCATGCTAT TGCTTCCCGTATGGCTTTCATTTTCTCCTCCTTGTATAAATCCTGGTTAGTTCTTGCCACGGC GGAACTCATCGCCGCCTGCCTTGCCCGCTGCTGGACAGGGGCTCGGCTGTTGGGCACTGAC AATTCCGTGGCTCGAGAGATCTTCGACTGTGCCTTCTAGTTGCCAGCCATCTGTTGTTTGCCC CTCCCCCGTGCCTTCCTTGACCCTGGAAGGTGCCACTCCCACTGTCCTTTCCTAATAAAATGA GGAAATTGCATCGCATTGTCTGAGTAGGTGTCATTCTATTCTGGGGGGTGGGGTGGGGCAG GACAGCAAGGGGGAGGATTGGGAAGACAATAGCAGGCATGAGATCTCACGTGCGGACCGA GCGGCCGC (SEQ ID NO: 232) |
| CN2150 (1878) GCGGCCGCACGCGTACGCTTGGACTAAGTCGGTTAGGAATAGGAATGGATAAATAATGGGG CAATACAAAGATCCCTGGTCAACTTCACAGTCTGTCATCTAGGTGCTCCGGTTTTTAACATCT |

| Fig 26 cont'd |
|---|
| Vector ID (length between ITRs) & Sequence Between ITRs |
| TCTGCAACCTTCGGGAAACAGAACAGATCATCGCAATCTACTGTTTTTTTTTTTTTTTCCTCTAA<br>GAAAATGCCCATGGAAAAGTGCTGGATGTCTTGCAAATCTGTTATCGCAATGCAAAATCACAC<br>CGAGTTTCTTTAAGAATCACAGTGCATTCCCTCTCTCCCAGAACTAAATAAAGCCTGCCTTGG<br>GAAGCAATTCAAAACTGGAATTCTGCTTCTACATTGCTCAGTTACCCAGGCAGCTGAAGCCTT<br>TGAACAGGTCTCAGAAAGTCCCTCAAATACAGTCTTTTTAGGTCAAATGAGAACAGTCCTGTT<br>AAGTCATACACTAATTCCTCTCTACAAACAGAAGTCTGGTTAATTCTCAGGGAGCTAAGAAAA<br>AAAACAAAGATCCTCTTTCTTCCAGAAAAATGAGCTCGGGCTGGGCATAAAAGTCAGGGCAG<br>AGCCATCTATTGCTTACATTTGCTTCTGGGATCCAGATCTTTCGAAGCTAGCGCTACCGGTCG<br>CCACCATGGTGAGCAAGGGCGAGGAGCTGTTCACCGGGGTGGTGCCCATCCTGGTCGAGC<br>TGGACGGCGACGTAAACGGCCACAAGTTCAGCGTGTCCGGCGAGGGCGAGGGCGATGCCA<br>CCTACGGCAAGCTGACCCTGAAGCTGATCTGCACCACCGGCAAGCTGCCCGTGCCCTGGCC<br>CACCCTCGTGACCACCCTGGGCTACGGCGTGCAGTGCTTCGCCCGCTACCCCGACCACATG<br>AAGCAGCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGACACCCTG<br>GTGAACCGCATCGAGCTGAAGGGCATCGACTTCAAGGAGGACGGCAACATCCTGGGGCACA<br>AGCTGGAGTACAACTACAACAGCCACAACGTCTATATCACCGCCGACAAGCAGAAGAACGGC<br>ATCAAGGCCAACTTCAAGATCCGCCACAACATCGAGGACGGCGGCGTGCAGCTCGCCGACC<br>ACTACCAGCAGAACACCCCCATCGGCGACGGCCCCGTGCTGCTGCCCGACAACCACTACCT<br>GAGCTACCAGTCCAAGCTGAGCAAAGACCCCAACGAGAAGCGCGATCACATGGTCCTGCTG<br>GAGTTCGTGACCGCCGCCGGGATCACTCTCGGCATGGACGAGCTGTACAAGTAAGTCGACG<br>GCGCGCCGCGGCCGCGAATTCGATATCATAATCAACCTCTGGATTACAAAATTTGTGAAAGA<br>TTGACTGGTATTCTTAACTATGTTGCTCCTTTTACGCTATGTGGATACGCTGCTTTAATGCCTT<br>TGTATCATGCTATTGCTTCCCGTATGGCTTTCATTTTCTCCTCCTTGTATAAATCCTGGTTAGT<br>TCTTGCCACGGCGGAACTCATCGCCGCCTGCCTTGCCCGCTGCTGGACAGGGGCTCGGCTG<br>TTGGGCACTGACAATTCCGTGGCTCGAGAGATCTTCGACTGTGCCTTCTAGTTGCCAGCCAT<br>CTGTTGTTTGCCCCTCCCCCGTGCCTTCCTTGACCCTGGAAGGTGCCACTCCCACTGTCCTT<br>TCCTAATAAAATGAGGAAATTGCATCGCATTGTCTGAGTAGGTGTCATTCTATTCTGGGGGGT<br>GGGGTGGGGCAGGACAGCAAGGGGGAGGATTGGGAAGACAATAGCAGGCATGAGATCTCA<br>CGTGCGGACCGAGCGGCCGC (SEQ ID NO: 233) |
| CN2151 (1745)<br>GCGGCCGCACGCGTACTTGGAGATGTCCCAGGAAACAGAATAAAATGTTTCAATATGGTATC<br>CTAGGAAAAGAAGGTTTTTATCCCACCTTATAATTAAATCTGAAAGATTCCTACAGTGAACTAA<br>GAGGTTTCTAATGAAGTACTAAGCTGCATTTAGAATTGGAGCAATGAAAGGCTCTTTGTTCTC<br>CTTTCAAAAGGTTCCAGTACAGAACAATTTGGCTCCCAATACAGGCATGTTTTAGACCACCTG<br>CAGGCTCTAATCTACGCAAATTTATTTGGTACAAACTTTCTTCTACGTCACCTTCTTATTCAGT<br>ATAATTCCAGAGAGGTTTATTGCTAACATTTAACAGTATTAATAAGAGAACAGTTGCTCTCATG<br>GGGACTGCCCTGGAAGGAAAAGAGCTCGGGCTGGGCATAAAAGTCAGGGCAGAGCCATCTA<br>TTGCTTACATTTGCTTCTGGGATCCAGATCTTTCGAAGCTAGCGCTACCGGTCGCCACCATG<br>GTGAGCAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCTACGGC<br>AAGCTGACCCTGAAGCTGATCTGCACCACCGGCAAGCTGCCCGTGCCCTGGCCCACCCTCG<br>TGACCACCCTGGGCTACGGCGTGCAGTGCTTCGCCCGCTACCCCGACCACATGAAGCAGCA<br>CGACTTCTTCAAGTCCGCCATGCCCGAAGGCTACGTCCAGGAGCGCACCATCTTCTTCAAGG<br>ACGACGGCAACTACAAGACCCGCGCCGAGGTGAAGTTCGAGGGCGACACCCTGGTGAACC<br>GCATCGAGCTGAAGGGCATCGACTTCAAGGAGGACGGCAACATCCTGGGGCACAAGCTGGA<br>GTACAACTACAACAGCCACAACGTCTATATCACCGCCGACAAGCAGAAGAACGGCATCAAGG<br>CCAACTTCAAGATCCGCCACAACATCGAGGACGGCGGCGTGCAGCTCGCCGACCACTACCA<br>GCAGAACACCCCCATCGGCGACGGCCCCGTGCTGCTGCCCGACAACCACTACCTGAGCTAC<br>CAGTCCAAGCTGAGCAAAGACCCCAACGAGAAGCGCGATCACATGGTCCTGCTGGAGTTCG |

| Fig 26 cont'd |
| --- |
| Vector ID (length between ITRs) & Sequence Between ITRs |
| TGACCGCCGCCGGGATCACTCTCGGCATGGACGAGCTGTACAAGTAAGTCGACGGCGCGCC GCGGCCGCGAATTCGATATCATAATCAACCTCTGGATTACAAAATTTGTGAAAGATTGACTGG TATTCTTAACTATGTTGCTCCTTTTACGCTATGTGGATACGCTGCTTTAATGCCTTTGTATCAT GCTATTGCTTCCCGTATGGCTTTCATTTTCTCCTCCTTGTATAAATCCTGGTTAGTTCTTGCCA CGGCGGAACTCATCGCCGCCTGCCTTGCCCGCTGCTGGACAGGGGCTCGGCTGTTGGGCA CTGACAATTCCGTGGCTCGAGAGATCTTCGACTGTGCCTTCTAGTTGCCAGCCATCTGTTGTT TGCCCCTCCCCCGTGCCTTCCTTGACCCTGGAAGGTGCCACTCCCACTGTCCTTTCCTAATA AAATGAGGAAATTGCATCGCATTGTCTGAGTAGGTGTCATTCTATTCTGGGGGGTGGGGTGG GGCAGGACAGCAAGGGGGAGGATTGGGAAGACAATAGCAGGCATGAGATCTCACGTGCGG ACCGAGCGGCCGC (SEQ ID NO: 234) |
| CN2152 (2091) GCGGCCGCACGCGTGGCTCAGGGCTCCATGACATGTGGCGACATGCATGAGCAGGGAGGC TCATGCCACCATGGAAGCAGGTGACCCTGGTGGCCCTGCCAGGACCCAGCCCCAAACCCCT TCCTGGGCCTTTGGCTCCCAGGGTCTCCTCAATGCAGCAGGGCAGAGCCTGGGAATTGGAC GCAGCACAGCCCGGCTCAGAGCCAGCAAAGTTCACACTGTTCTTTGGGGAGAAAGGCGCTC AGAAGAGATGCCTGGGCCCTTTGTCCTGTAGCTTGGTAACACAAAATTCTCACACTTGTCAAA AAAAAAAGGGGGGCTATCCAACACCCCCGCCCTTCCTCCCGGGCCCCCTACCCCCATGCAGT GACTAGAGCTGTGGTCAAGGACTCTTCTTCCCCAAGGCAGAGGAGGCACAGTGGGCTGCCA GATTGCCAACCCGGCCAGGACAAAAGGCCTTTGACAGCTCCCTGCTGCGGTTCAGCAGTGA CCCAGAGGCTGGCCCTGAGAGGACACGGCTCTGCCCAGTCCCTGGAGAGTCCCCAGGTCT GCTAGTGAAGCCCTGCGGCCCTCAAGCCAGGATGACTCTTTCCCTCTTGGCTGCAACCAAAT TTCCAAGGGCCTGCATGTGCGCCCATCTGTCTACTGTCCACCGCAGAGGTGAAACGGGAAC ATGACCCCACCCGCCCCTCTGCACCCTGAGGTCACATCCGACCAGCACAGTCGTGCCTCAC CCTGCACCTGAGACGAGCTCGGGCTGGGCATAAAAGTCAGGGCAGAGCCATCTATTGCTTA CATTTGCTTCTGGGATCCAGATCTTTCGAAGCTAGCGCTACCGGTCGCCACCATGGTGAGCA AGGGCGAGGAGCTGTTCACCGGGGTGGTGCCCATCCTGGTCGAGCTGGACGGCGACGTAA ACGGCCACAAGTTCAGCGTGTCCGGCGAGGGCGAGGGCGATGCCACCTACGGCAAGCTGA CCCTGAAGCTGATCTGCACCACCGGCAAGCTGCCCGTGCCCTGGCCCACCCTCGTGACCAC CCTGGGCTACGGCGTGCAGTGCTTCGCCCGCTACCCCGACCACATGAAGCAGCACGACTTC TTCAAGTCCGCCATGCCCGAAGGCTACGTCCAGGAGCGCACCATCTTCTTCAAGGACGACG GCAACTACAAGACCCGCGCCGAGGTGAAGTTCGAGGGCGACACCCTGGTGAACCGCATCGA GCTGAAGGGCATCGACTTCAAGGAGGACGGCAACATCCTGGGGCACAAGCTGGAGTACAAC TACAACAGCCACAACGTCTATATCACCGCCGACAAGCAGAAGAACGGCATCAAGGCCAACTT CAAGATCCGCCACAACATCGAGGACGGCGGCGTGCAGCTCGCCGACCACTACCAGCAGAAC ACCCCCATCGGCGACGGCCCCGTGCTGCTGCCCGACAACCACTACCTGAGCTACCAGTCCA AGCTGAGCAAAGACCCCAACGAGAAGCGCGATCACATGGTCCTGCTGGAGTTCGTGACCGC CGCCGGGATCACTCTCGGCATGGACGAGCTGTACAAGTAAGTCGACGGCGCGCCGCGGCC GCGAATTCGATATCATAATCAACCTCTGGATTACAAAATTTGTGAAAGATTGACTGGTATTCTT AACTATGTTGCTCCTTTTACGCTATGTGGATACGCTGCTTTAATGCCTTTGTATCATGCTATTG CTTCCCGTATGGCTTTCATTTTCTCCTCCTTGTATAAATCCTGGTTAGTTCTTGCCACGGCGG AACTCATCGCCGCCTGCCTTGCCCGCTGCTGGACAGGGGCTCGGCTGTTGGGCACTGACAA TTCCGTGGCTCGAGAGATCTTCGACTGTGCCTTCTAGTTGCCAGCCATCTGTTGTTTGCCCCT CCCCCGTGCCTTCCTTGACCCTGGAAGGTGCCACTCCCACTGTCCTTTCCTAATAAAATGAG GAAATTGCATCGCATTGTCTGAGTAGGTGTCATTCTATTCTGGGGGGTGGGGTGGGGCAGG ACAGCAAGGGGGAGGATTGGGAAGACAATAGCAGGCATGAGATCTCACGTGCGGACCGAGC GGCCGC (SEQ ID NO: 235) |
| CN2153 (2049) GCGGCCGCACGCGTCCCCAAGCAAGGTCAACAGCAGCTTCAATTACAAGACAAACTTAACAA GAGTTGCTATAAACCAAGTACTCTGTATTGACTTAAGAACAGGCTCCACTCCACATATTGCCA |

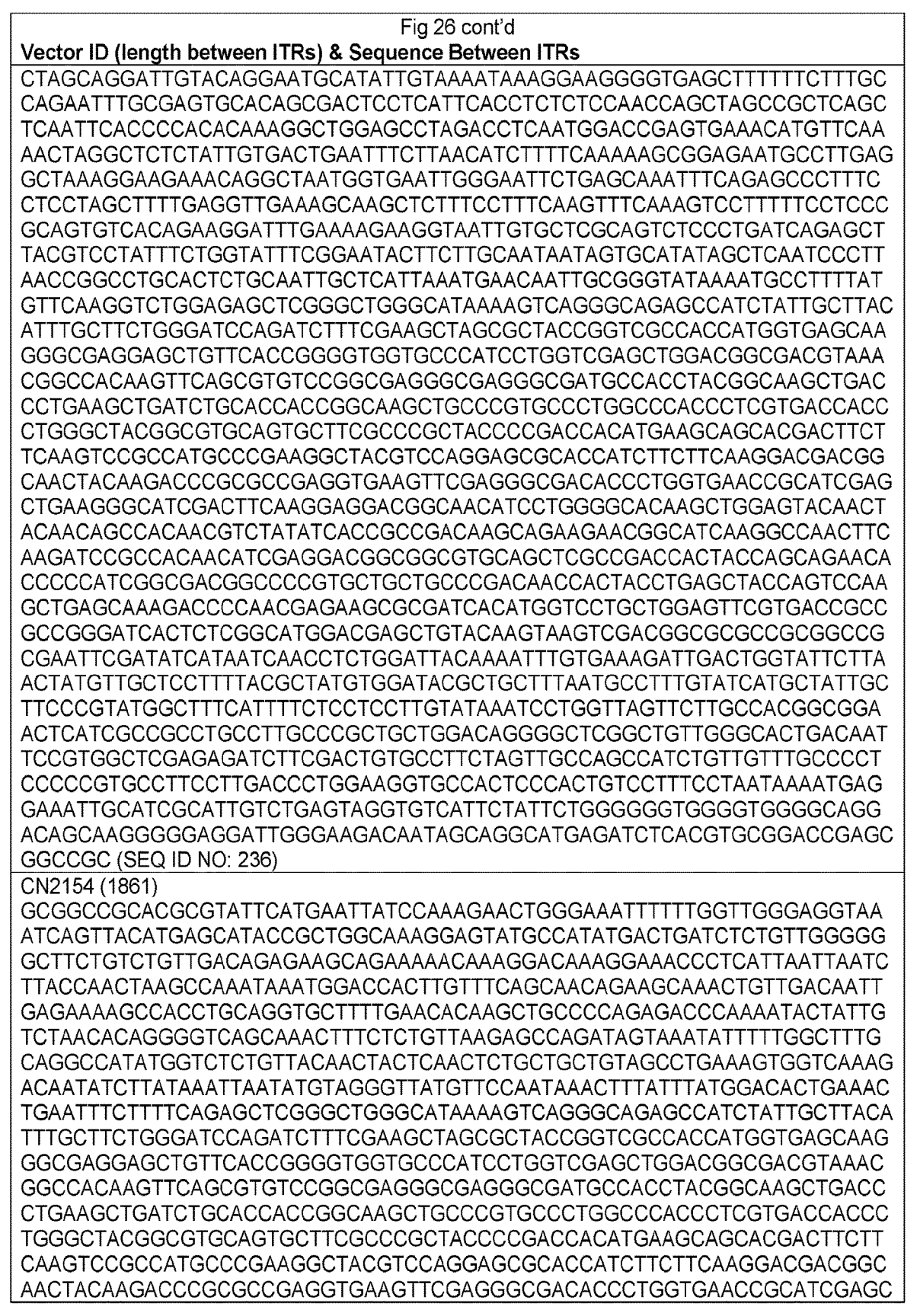

| Fig 26 cont'd |
| :--- |
| Vector ID (length between ITRs) & Sequence Between ITRs |
| CTAGCAGGATTGTACAGGAATGCATATTGTAAAATAAAGGAAGGGGTGAGCTTTTTTCTTTGC CAGAATTTGCGAGTGCACAGCGACTCCTCATTCACCTCTCTCCAACCAGCTAGCCGCTCAGC TCAATTCACCCCACACAAAGGCTGGAGCCTAGACCTCAATGGACCGAGTGAAACATGTTCAA AACTAGGCTCTCTATTGTGACTGAATTTCTTAACATCTTTTCAAAAAGCGGAGAATGCCTTGAG GCTAAAGGAAGAAACAGGCTAATGGTGAATTGGGAATTCTGAGCAAATTTCAGAGCCCTTTC CTCCTAGCTTTTGAGGTTGAAAGCAAGCTCTTTCCTTTCAAGTTTCAAAGTCCTTTTTCCTCCC GCAGTGTCACAGAAGGATTTGAAAAGAAGGTAATTGTGCTCGCAGTCTCCCTGATCAGAGCT TACGTCCTATTTCTGGTATTTCGGAATACTTCTTGCAATAATAGTGCATATAGCTCAATCCCTT AACCGGCCTGCACTCTGCAATTGCTCATTAAATGAACAATTGCGGGTATAAAATGCCTTTTAT GTTCAAGGTCTGGAGAGCTCGGGCTGGGCATAAAAGTCAGGGCAGAGCCATCTATTGCTTAC ATTTGCTTCTGGGATCCAGATCTTTCGAAGCTAGCGCTACCGGTCGCCACCATGGTGAGCAA GGGCGAGGAGCTGTTCACCGGGGTGGTGCCCATCCTGGTCGAGCTGGACGGCGACGTAAA CGGCCACAAGTTCAGCGTGTCCGGCGAGGGCGAGGGCGATGCCACCTACGGCAAGCTGAC CCTGAAGCTGATCTGCACCACCGGCAAGCTGCCCGTGCCCTGGCCCACCCTCGTGACCACC CTGGGCTACGGCGTGCAGTGCTTCGCCCGCTACCCCGACCACATGAAGCAGCACGACTTCT TCAAGTCCGCCATGCCCGAAGGCTACGTCCAGGAGCGCACCATCTTCTTCAAGGACGACGG CAACTACAAGACCCGCGCCGAGGTGAAGTTCGAGGGCGACACCCTGGTGAACCGCATCGAG CTGAAGGGCATCGACTTCAAGGAGGACGGCAACATCCTGGGGCACAAGCTGGAGTACAACT ACAACAGCCACAACGTCTATATCACCGCCGACAAGCAGAAGAACGGCATCAAGGCCAACTTC AAGATCCGCCACAACATCGAGGACGGCGGCGTGCAGCTCGCCGACCACTACCAGCAGAACA CCCCCATCGGCGACGGCCCCGTGCTGCTGCCCGACAACCACTACCTGAGCTACCAGTCCAA GCTGAGCAAAGACCCCAACGAGAAGCGCGATCACATGGTCCTGCTGGAGTTCGTGACCGCC GCCGGGATCACTCTCGGCATGGACGAGCTGTACAAGTAAGTCGACGGCGCGCCGCGGCCG CGAATTCGATATCATAATCAACCTCTGGATTACAAAATTTGTGAAAGATTGACTGGTATTCTTA ACTATGTTGCTCCTTTTACGCTATGTGGATACGCTGCTTTAATGCCTTTGTATCATGCTATTGC TTCCCGTATGGCTTTCATTTTCTCCTCCTTGTATAAATCCTGGTTAGTTCTTGCCACGGCGGA ACTCATCGCCGCCTGCCTTGCCCGCTGCTGGACAGGGGCTCGGCTGTTGGGCACTGACAAT TCCGTGGCTCGAGAGATCTTCGACTGTGCCTTCTAGTTGCCAGCCATCTGTTGTTTGCCCCT CCCCCGTGCCTTCCTTGACCCTGGAAGGTGCCACTCCCACTGTCCTTTCCTAATAAAATGAG GAAATTGCATCGCATTGTCTGAGTAGGTGTCATTCTATTCTGGGGGGTGGGGTGGGGCAGG ACAGCAAGGGGGAGGATTGGGAAGACAATAGCAGGCATGAGATCTCACGTGCGGACCGAGC GGCCGC (SEQ ID NO: 236) |
| CN2154 (1861) GCGGCCGCACGCGTATTCATGAATTATCCAAAGAACTGGGAAATTTTTTGGTTGGGAGGTAA ATCAGTTACATGAGCATACCGCTGGCAAAGGAGTATGCCATATGACTGATCTCTGTTGGGGG GCTTCTGTCTGTTGACAGAGAAGCAGAAAAACAAAGGACAAAGGAAACCCTCATTAATTAATC TTACCAACTAAGCCAAATAAATGGACCACTTGTTTCAGCAACAGAAGCAAACTGTTGACAATT GAGAAAAGCCACCTGCAGGTGCTTTTGAACACAAGCTGCCCCAGAGACCCAAAATACTATTG TCTAACACAGGGGTCAGCAAACTTTCTCTGTTAAGAGCCAGATAGTAAATATTTTTGGCTTTG CAGGCCATATGGTCTCTGTTACAACTACTCAACTCTGCTGCTGTAGCCTGAAAGTGGTCAAAG ACAATATCTTATAAATTAATATGTAGGGTTATGTTCCAATAAACTTTATTTATGGACACTGAAAC TGAATTTCTTTTCAGAGCTCGGGCTGGGCATAAAAGTCAGGGCAGAGCCATCTATTGCTTACA TTTGCTTCTGGGATCCAGATCTTTCGAAGCTAGCGCTACCGGTCGCCACCATGGTGAGCAAG GCGAGGAGCTGTTCACCGGGGTGGTGCCCATCCTGGTCGAGCTGGACGGCGACGTAAAC GGCCACAAGTTCAGCGTGTCCGGCGAGGGCGAGGGCGATGCCACCTACGGCAAGCTGACC CTGAAGCTGATCTGCACCACCGGCAAGCTGCCCGTGCCCTGGCCCACCCTCGTGACCACCC TGGGCTACGGCGTGCAGTGCTTCGCCCGCTACCCCGACCACATGAAGCAGCACGACTTCTT CAAGTCCGCCATGCCCGAAGGCTACGTCCAGGAGCGCACCATCTTCTTCAAGGACGACGGC AACTACAAGACCCGCGCCGAGGTGAAGTTCGAGGGCGACACCCTGGTGAACCGCATCGAGC |

| Fig 26 cont'd |
|---|
| Vector ID (length between ITRs) & Sequence Between ITRs |
| TGAAGGGCATCGACTTCAAGGAGGACGGCAACATCCTGGGGCACAAGCTGGAGTACAACTA<br>CAACAGCCACAACGTCTATATCACCGCCGACAAGCAGAAGAACGGCATCAAGGCCAACTTCA<br>AGATCCGCCACAACATCGAGGACGGCGGCGTGCAGCTCGCCGACCACTACCAGCAGAACAC<br>CCCCATCGGCGACGGCCCCGTGCTGCTGCCCGACAACCACTACCTGAGCTACCAGTCCAAG<br>CTGAGCAAAGACCCCAACGAGAAGCGCGATCACATGGTCCTGCTGGAGTTCGTGACCGCCG<br>CCGGGATCACTCTCGGCATGGACGAGCTGTACAAGTAAGTCGACGGCGCGCCGCGGCCGC<br>GAATTCGATATCATAATCAACCTCTGGATTACAAAATTTGTGAAAGATTGACTGGTATTCTTAA<br>CTATGTTGCTCCTTTTACGCTATGTGGATACGCTGCTTTAATGCCTTTGTATCATGCTATTGCT<br>TCCCGTATGGCTTTCATTTTCTCCTCCTTGTATAAATCCTGGTTAGTTCTTGCCACGGCGGAA<br>CTCATCGCCGCCTGCCTTGCCCGCTGCTGGACAGGGGCTCGGCTGTTGGGCACTGACAATT<br>CCGTGGCTCGAGAGATCTTCGACTGTGCCTTCTAGTTGCCAGCCATCTGTTGTTTGCCCCTC<br>CCCCGTGCCTTCCTTGACCCTGGAAGGTGCCACTCCCACTGTCCTTTCCTAATAAAATGAGG<br>AAATTGCATCGCATTGTCTGAGTAGGTGTCATTCTATTCTGGGGGGTGGGGTGGGGCAGGAC<br>AGCAAGGGGGAGGATTGGGAAGACAATAGCAGGCATGAGATCTCACGTGCGGACCGAGCG<br>GCCGC (SEQ ID NO: 237) |
| CN2155 (1913)<br>GCGGCCGCACGCGGACTTTTATGCCCAGCCCGAGCTCTGAGGCATAGACACACAGTGGAAA<br>ATCATTTCTCTTTTCAGTAAGTTTTGGGTCTGCTTTAAATTGATCATTTGTTTCATCAGCTAATC<br>CCCAAACAGAGGGCACGTCCGCTCTACTTGCAAAATTCTTGTATGTAAGTTGAATTCTCCCTT<br>TATCAACTCAGGCCAATAAGTACTTTATTTTGTTTTTGCTTGTTGTTAGGGAAAAAAAAAAAA<br>ACAAAGATAATCAGCTCATACTACTTGCGTAGCTGTCTGCATTTTAATTCCAGACTATGAACGA<br>GCGTCAGAGTGCCCTTATGATATTTTGCACAAAAGGCTCAGTGTTTATGACTCTACTCAGAGA<br>ACCCAAAATAGCATTGAGTAAGCAGTGACATACTGACAGTGTTGTGGTACTAAAAGCACAAGC<br>GTCTGTAACTCTGGGCAATGGGGCACATCGAGAGTTTGCTGAGAAGACTGTGAAGCAAAAAG<br>AAGAAAGTTTTTCCTACTCTTCCTTATGTGTCCAACACGAAGTTTGCTGTACGCGTGCGGCCG<br>CAGGAACGGGCTGGGCATAAAAGTCAGGGCAGAGCCATCTATTGCTTACATTTGCTTCTGGG<br>ATCCAGATCTTTCGAAGCTAGCGCTACCGGTCGCCACCATGGTGAGCAAGGGCGAGGAGCT<br>GTTCACCGGGGTGGTGCCCATCCTGGTCGAGCTGGACGGCGACGTAAACGGCCACAAGTTC<br>AGCGTGTCCGGCGAGGGCGAGGGCGATGCCACCTACGGCAAGCTGACCCTGAAGCTGATC<br>TGCACCACCGGCAAGCTGCCCGTGCCCTGGCCCACCCTCGTGACCACCCTGGGCTACGGC<br>GTGCAGTGCTTCGCCCGCTACCCCGACCACATGAAGCAGCACGACTTCTTCAAGTCCGCCAT<br>GCCCGAAGGCTACGTCCAGGAGCGCACCATCTTCTTCAAGGACGACGGCAACTACAAGACC<br>CGCGCCGAGGTGAAGTTCGAGGGCGACACCCTGGTGAACCGCATCGAGCTGAAGGGCATC<br>GACTTCAAGGAGGACGGCAACATCCTGGGGCACAAGCTGGAGTACAACTACAACAGCCACA<br>ACGTCTATATCACCGCCGACAAGCAGAAGAACGGCATCAAGGCCAACTTCAAGATCCGCCAC<br>AACATCGAGGACGGCGGCGTGCAGCTCGCCGACCACTACCAGCAGAACACCCCCATCGGC<br>GACGGCCCCGTGCTGCTGCCCGACAACCACTACCTGAGCTACCAGTCCAAGCTGAGCAAAG<br>ACCCCAACGAGAAGCGCGATCACATGGTCCTGCTGGAGTTCGTGACCGCCGCCGGGATCAC<br>TCTCGGCATGGACGAGCTGTACAAGTAAGTCGACGGCGCGCCGCGGCCGCGAATTCGATAT<br>CATAATCAACCTCTGGATTACAAAATTTGTGAAAGATTGACTGGTATTCTTAACTATGTTGCTC<br>CTTTTACGCTATGTGGATACGCTGCTTTAATGCCTTTGTATCATGCTATTGCTTCCCGTATGGC<br>TTTCATTTTCTCCTCCTTGTATAAATCCTGGTTAGTTCTTGCCACGGCGGAACTCATCGCCGC<br>CTGCCTTGCCCGCTGCTGGACAGGGGCTCGGCTGTTGGGCACTGACAATTCCGTGGCTCGA<br>GAGATCTTCGACTGTGCCTTCTAGTTGCCAGCCATCTGTTGTTTGCCCCTCCCCCGTGCCTT<br>CCTTGACCCTGGAAGGTGCCACTCCCACTGTCCTTTCCTAATAAAATGAGGAAATTGCATCGC<br>ATTGTCTGAGTAGGTGTCATTCTATTCTGGGGGGTGGGGTGGGGCAGGACAGCAAGGGGGA<br>GGATTGGGAAGACAATAGCAGGCATGAGATCTCACGTGCGGACCGAGCGGCCGC (SEQ ID<br>NO: 238) |

| Fig 26 cont'd |
| --- |
| Vector ID (length between ITRs) & Sequence Between ITRs |
| CN2156 (1869)<br>GCGGCCGCACGCGTAGTTCAGCTCTTTAATTTNCCATTGGCTCTAACCAAGACAGAAGACTTT<br>ACTTAAGCAATTGGTTTGAAATTAGATGGACAAGCTGAAACAATGGGCTCTCTGTTCTTTCCT<br>CTCTGTGCCCACCAACTGGCATTCATTATTTAATCTGTGACGTGTGTTGCCAGGGCTGCGGT<br>AATGACAACGGCACCTATTGTCTTCACATCCCTTCCCTATTCTGTAACATCTGTCATGGCTCC<br>TGTCTATATTTCATTTTATTTTGTTTTATTTTGCTTCTTTTACTTTTACAAGGTTATTCTTAATTAC<br>TACAAATTGCTCTGAAATCTATTCTAACCCTGCAAAGTGTAGCATCATTTTGTAACTTGGCAAT<br>AACAATAAACTGAAGGCGCGTGTGATAGCACCCTTTTAAATTACTGTAATTTTACATAAAACTG<br>TATAATTTCAAACAAATTTTATCTCAAGGTTAACTAGATAACCTCTCTTTTTAAATACCTGATCA<br>GTTCACAGACGACTGAGCTCGGGCTGGGCATAAAAGTCAGGGCAGAGCCATCTATTGCTTAC<br>ATTTGCTTCTGGGATCCAGATCTTTCGAAGCTAGCGCTACCGGTCGCCACCATGGTGAGCAA<br>GGGCGAGGAGCTGTTCACCGGGGTGGTGCCCATCCTGGTCGAGCTGGACGGCGACGTAAA<br>CGGCCACAAGTTCAGCGTGTCCGGCGAGGGCGAGGGCGATGCCACCTACGGCAAGCTGAC<br>CCTGAAGCTGATCTGCACCACCGGCAAGCTGCCCGTGCCCTGGCCCACCCTCGTGACCACC<br>CTGGGCTACGGCGTGCAGTGCTTCGCCCGCTACCCCGACCACATGAAGCAGCACGACTTCT<br>TCAAGTCCGCCATGCCCGAAGGCTACGTCCAGGAGCGCACCATCTTCTTCAAGGACGACGG<br>CAACTACAAGACCCGCGCCGAGGTGAAGTTCGAGGGCGACACCCTGGTGAACCGCATCGAG<br>CTGAAGGGCATCGACTTCAAGGAGGACGGCAACATCCTGGGGCACAAGCTGGAGTACAACT<br>ACAACAGCCACAACGTCTATATCACCGCCGACAAGCAGAAGAACGGCATCAAGGCCAACTTC<br>AAGATCCGCCACAACATCGAGGACGGCGGCGTGCAGCTCGCCGACCACTACCAGCAGAACA<br>CCCCCATCGGCGACGGCCCCGTGCTGCTGCCCGACAACCACTACCTGAGCTACCAGTCCAA<br>GCTGAGCAAAGACCCCAACGAGAAGCGCGATCACATGGTCCTGCTGGAGTTCGTGACCGCC<br>GCCGGGATCACTCTCGGCATGGACGAGCTGTACAAGTAAGTCGACGGCGCGCCGCGGCCG<br>CGAATTCGATATCATAATCAACCTCTGGATTACAAAATTTGTGAAAGATTGACTGGTATTCTTA<br>ACTATGTTGCTCCTTTTACGCTATGTGGATACGCTGCTTTAATGCCTTTGTATCATGCTATTGC<br>TTCCCGTATGGCTTTCATTTTCTCCTCCTTGTATAAATCCTGGTTAGTTCTTGCCACGGCGGA<br>ACTCATCGCCGCCTGCCTTGCCCGCTGCTGGACAGGGGCTCGGCTGTTGGGCACTGACAAT<br>TCCGTGGCTCGAGAGATCTTCGACTGTGCCTTCTAGTTGCCAGCCATCTGTTGTTTGCCCCT<br>CCCCCGTGCCTTCCTTGACCCTGGAAGGTGCCACTCCCACTGTCCTTTCCTAATAAAATGAG<br>GAAATTGCATCGCATTGTCTGAGTAGGTGTCATTCTATTCTGGGGGGTGGGGTGGGGCAGG<br>ACAGCAAGGGGGAGGATTGGGAAGACAATAGCAGGCATGAGATCTCACGTGCGGACCGAGC<br>GGCCGC (SEQ ID NO: 239) |
| CN2157 (1982)<br>GCGGCCGCACGCGTCTGGCCTTGGTCTCTCCTGGGCTAGAACAGGCCCCTTGTCTGCCTCC<br>CTGAATCACTCTTGAGGCTGGGCATGCACCTTCCCCCACTCCAGATGTGCTGACAGCAGAAA<br>TGCCAACCCCTCCCTTGAGGGCCAGTGAATTCAGCAGTGACAGGTCACTCTCTGAGCGAGA<br>CTGGTTCTCCCTTCATCCGCTTGTAAAGGGAAAAACAGCCTCGGCCTCTGAGCCTGGCACCA<br>CCAGGTTTGGCCAGTCTTGGTTGTTTGCCTAAGTCCCAGTGCCTTCAGTTCCCATCCCTCTTC<br>TCTGACCCCCAACTCCTGAGCCCCTTGCCTGTCACCCTCCCCCACCCCAGCTGCTGCATGTG<br>CCAACCCCCCACCCAGGAGAAAACGAGGCTCTTGGAAGGGAATAAATGGAGGCTCTGTGCA<br>GGCTTGCAGCTGAAATGGCCCTGTGCGCGGCCACAGATGGGCCTCCTCTCCCCCTCCACAT<br>TTCTGCATCAACAAAGCGTGACCTTGTTTGGATGACAGTCGCCCCATGTTTTCCCCATGACAA<br>TGCTTGCCTTGCCTTTGCCTCCCAGCGGGCTGTCTCAGGACATCTCTGTTCCCTGAAATTGG<br>GAAAGGGTGGTGGGGTGGAAGAGCTCGGGCTGGGCATAAAAGTCAGGGCAGAGCCATCTAT<br>TGCTTACATTTGCTTCTGGGATCCAGATCTTTCGAAGCTAGCGCTACCGGTCGCCACCATGG<br>TGAGCAAGGGCGAGGAGCTGTTCACCGGGGTGGTGCCCATCCTGGTCGAGCTGGACGGCG<br>ACGTAAACGGCCACAAGTTCAGCGTGTCCGGCGAGGGCGAGGGCGATGCCACCTACGGCA<br>AGCTGACCCTGAAGCTGATCTGCACCACCGGCAAGCTGCCCGTGCCCTGGCCCACCCTCGT<br>GACCACCCTGGGCTACGGCGTGCAGTGCTTCGCCCGCTACCCCGACCACATGAAGCAGCAC |

| Fig 26 cont'd |
| :--- |
| Vector ID (length between ITRs) & Sequence Between ITRs |
| GACTTCTTCAAGTCCGCCATGCCCGAAGGCTACGTCCAGGAGCGCACCATCTTCTTCAAGGA<br>CGACGGCAACTACAAGACCCGCGCCGAGGTGAAGTTCGAGGGCGACACCCTGGTGAACCG<br>CATCGAGCTGAAGGGCATCGACTTCAAGGAGGACGGCAACATCCTGGGGCACAAGCTGGAG<br>TACAACTACAACAGCCACAACGTCTATATCACCGCCGACAAGCAGAAGAACGGCATCAAGGC<br>CAACTTCAAGATCCGCCACAACATCGAGGACGGCGGCGTGCAGCTCGCCGACCACTACCAG<br>CAGAACACCCCCATCGGCGACGGCCCCGTGCTGCTGCCCGACAACCACTACCTGAGCTACC<br>AGTCCAAGCTGAGCAAAGACCCCAACGAGAAGCGCGATCACATGGTCCTGCTGGAGTTCGT<br>GACCGCCGCCGGGATCACTCTCGGCATGGACGAGCTGTACAAGTAAGTCGACGGCGCGCC<br>GCGGCCGCGAATTCGATATCATAATCAACCTCTGGATTACAAAATTTGTGAAAGATTGACTGG<br>TATTCTTAACTATGTTGCTCCTTTTACGCTATGTGGATACGCTGCTTTAATGCCTTTGTATCAT<br>GCTATTGCTTCCCGTATGGCTTTCATTTTCTCCTCCTTGTATAAATCCTGGTTAGTTCTTGCCA<br>CGGCGGAACTCATCGCCGCCTGCCTTGCCCGCTGCTGGACAGGGGCTCGGCTGTTGGGCA<br>CTGACAATTCCGTGGCTCGAGAGATCTTCGACTGTGCCTTCTAGTTGCCAGCCATCTGTTGTT<br>TGCCCCTCCCCCGTGCCTTCCTTGACCCTGGAAGGTGCCACTCCCACTGTCCTTTCCTAATA<br>AAATGAGGAAATTGCATCGCATTGTCTGAGTAGGTGTCATTCTATTCTGGGGGGTGGGGTGG<br>GGCAGGACAGCAAGGGGGAGGATTGGGAAGACAATAGCAGGCATGAGATCTCACGTGCGG<br>ACCGAGCGGCCGC (SEQ ID NO: 240) |
| CN2158 (1698)<br>GCGGCCGCACGCGTGTCTGCTTTCAGGCTGCTCAGCAAAACATCCCTAGACTCACCACCCA<br>GAACAGAGTGTAAAGTGGGCTTGCAGATAGATGAAGGGAACCATTGGTGAGGCTTGCTCTCC<br>TATCTATTGCTCATATTCCTAGATCTTGAGCTCAGGCCCTGTGAAGAACAAGCCTGGGCTTTG<br>TGCATTGTGCCTGCTGCTGCTGCTGCTGCAGGGACAGCTAGTGGGCATCTCTTCCGCCCTCT<br>GGCTCCGTCAAGCTCCCCGAGAAAAGGAACCATTGACTCTTACTGCCTTGGAACCTAGTGGT<br>ACCATCCGAGTGGTAGAGAAAGTGCCAGGCAGGGTGAATGTGGAGAGCTCGGGCTGGGCAT<br>AAAAGTCAGGGCAGAGCCATCTATTGCTTACATTTGCTTCTGGGATCCAGATCTTTCGAAGCT<br>AGCGCTACCGGTCGCCACCATGGTGAGCAAGGGCGAGGAGCTGTTCACCGGGGTGGTGCC<br>CATCCTGGTCGAGCTGGACGGCGACGTAAACGGCCACAAGTTCAGCGTGTCCGGCGAGGG<br>CGAGGGCGATGCCACCTACGGCAAGCTGACCCTGAAGCTGATCTGCACCACCGGCAAGCTG<br>CCCGTGCCCTGGCCCACCCTCGTGACCACCCTGGGCTACGGCGTGCAGTGCTTCGCCCGCT<br>ACCCCGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGAAGTTC<br>GAGGGCGACACCCTGGTGAACCGCATCGAGCTGAAGGGCATCGACTTCAAGGAGGACGGC<br>AACATCCTGGGGCACAAGCTGGAGTACAACTACAACAGCCACAACGTCTATATCACCGCCGA<br>CAAGCAGAAGAACGGCATCAAGGCCAACTTCAAGATCCGCCACAACATCGAGGACGGCGGC<br>GTGCAGCTCGCCGACCACTACCAGCAGAACACCCCCATCGGCGACGGCCCCGTGCTGCTG<br>CCCGACAACCACTACCTGAGCTACCAGTCCAAGCTGAGCAAAGACCCCAACGAGAAGCGCG<br>ATCACATGGTCCTGCTGGAGTTCGTGACCGCCGCCGGGATCACTCTCGGCATGGACGAGCT<br>GTACAAGTAAGTCGACGGCGCGCCGCGGCCGCGAATTCGATATCATAATCAACCTCTGGATT<br>ACAAAATTTGTGAAAGATTGACTGGTATTCTTAACTATGTTGCTCCTTTTACGCTATGTGGATA<br>CGCTGCTTTAATGCCTTTGTATCATGCTATTGCTTCCCGTATGGCTTTCATTTTCTCCTCCTTG<br>TATAAATCCTGGTTAGTTCTTGCCACGGCGGAACTCATCGCCGCCTGCCTTGCCCGCTGCTG<br>GACAGGGGCTCGGCTGTTGGGCACTGACAATTCCGTGGCTCGAGAGATCTTCGACTGTGCC<br>TTCTAGTTGCCAGCCATCTGTTGTTTGCCCCTCCCCCGTGCCTTCCTTGACCCTGGAAGGTG<br>CCACTCCCACTGTCCTTTCCTAATAAAATGAGGAAATTGCATCGCATTGTCTGAGTAGGTGTC<br>ATTCTATTCTGGGGGGTGGGGTGGGGCAGGACAGCAAGGGGGAGGATTGGGAAGACAATA<br>GCAGGCATGAGATCTCACGTGCGGACCGAGCGGCCGC (SEQ ID NO: 241) |
| CN2159 (1782)<br>GCGGCCGCACGCGTGGAGATTTGGTCCTGATTTTGAATGGTTTTTCTTGGTGGGCAGTGGTT<br>GTCTGAGGCTTTGAACTGATCTTTAACACACAGGAATGAGTTCTAGGCACTTCTGGAGTGGTC |

| Fig 26 cont'd |
|---|
| Vector ID (length between ITRs) & Sequence Between ITRs |
| CAGAGCACCTCTAAATACGAAGCAGCAGATGAGGTCATGGTAATTCGGGGAGTCAGAAGTG<br>GAAGGGTGGGGGGTTGAAAGCTATAATCACTGTCAAAGGGGTGTTTTCTGTAGACAAGTGAA<br>TGGAGCTATTGTACACAAACTCAGTGGTTGCCAAGCATGTGGCCCAATTATTTTGCCTTCATG<br>AGCATGGCACGGAAGGATCTCTTTAGAGAACTTGATTCACACAAGTTTGTGTTTAGTCTAACG<br>GTAGCAGGCAAAAGCCTGGGGAATTTGAACCTAAGAGTCTTTACAAGTTCCTGCCTCCCAAA<br>TCGAGCTCGGGCTGGGCATAAAAGTCAGGGCAGAGCCATCTATTGCTTACATTTGCTTCTGG<br>GATCCAGATCTTTCGAAGCTAGCGCTACCGGTCGCCACCATGGTGAGCAAGGGCGAGGAGC<br>TGTTCACCGGGGTGGTGCCCATCCTGGTCGAGCTGGACGGCGACGTAAACGGCCACAAGTT<br>CAGCGTGTCCGGCGAGGGCGAGGGCGATGCCACCTACGGCAAGCTGACCCTGAAGCTGAT<br>CTGCACCACCGGCAAGCTGCCCGTGCCCTGGCCCACCCTCGTGACCACCCTGGGCTACGG<br>CGTGCAGTGCTTCGCCCGCTACCCCGACCACATGAAGCAGCACGACTTCTTCAAGTCCGCC<br>ATGCCCGAAGGCTACGTCCAGGAGCGCACCATCTTCTTCAAGGACGACGGCAACTACAAGA<br>CCCGCGCCGAGGTGAAGTTCGAGGGCGACACCCTGGTGAACCGCATCGAGCTGAAGGGCA<br>TCGACTTCAAGGAGGACGGCAACATCCTGGGGCACAAGCTGGAGTACAACTACAACAGCCA<br>CAACGTCTATATCACCGCCGACAAGCAGAAGAACGGCATCAAGGCCAACTTCAAGATCCGCC<br>ACAACATCGAGGACGGCGGCGTGCAGCTCGCCGACCACTACCAGCAGAACACCCCCATCGG<br>CGACGGCCCCGTGCTGCTGCCCGACAACCACTACCTGAGCTACCAGTCCAAGCTGAGCAAA<br>GACCCCAACGAGAAGCGCGATCACATGGTCCTGCTGGAGTTCGTGACCGCCGCCGGGATCA<br>CTCTCGGCATGGACGAGCTGTACAAGTAAGTCGACGGCGCGCCGCGGCCGCGAATTCGATA<br>TCATAATCAACCTCTGGATTACAAAATTTGTGAAAGATTGACTGGTATTCTTAACTATGTTGCT<br>CCTTTTACGCTATGTGGATACGCTGCTTTAATGCCTTTGTATCATGCTATTGCTTCCCGTATGG<br>CTTTCATTTTCTCCTCCTTGTATAAATCCTGGTTAGTTCTTGCCACGGCGGAACTCATCGCCG<br>CCTGCCTTGCCCGCTGCTGGACAGGGGCTCGGCTGTTGGGCACTGACAATTCCGTGGCTCG<br>AGAGATCTTCGACTGTGCCTTCTAGTTGCCAGCCATCTGTTGTTTGCCCCTCCCCCGTGCCTT<br>CCTTGACCCTGGAAGGTGCCACTCCCACTGTCCTTTCCTAATAAAATGAGGAAATTGCATCGC<br>ATTGTCTGAGTAGGTGTCATTCTATTCTGGGGGGTGGGGTGGGGCAGGACAGCAAGGGGGA<br>GGATTGGGAAGACAATAGCAGGCATGAGATCTCACGTGCGGACCGAGCGGCCGC (SEQ ID NO: 242) |
| CN2160 (1858)<br>GCGGCCGCACGCGTGCTCCGGCCTCTCTATTCCCACTGCTCCATCCAGGAAAACCACGCCC<br>AGCATGGCAAAGCAAACCCTTCCTGGGGTCCCCCTCACTGGGGACACATCTGGGCAAGCCA<br>AGGACACTCAGAACTCAGCCTGGCCAGGCTCGGTCCCCACCCCCGCTCTGGCCCTTCTCCC<br>TACAGTGAAAGGGACTTTATGGGGACAAAAAGCCACCCATTGTATCACACGAGACAAAGGGG<br>CAGGGGACAGAGGCTCCGGGCGCCTAAGCTGGCCACGACACAGCCACACACCACCCCCTG<br>ACTGTGTGAGAGGGAGGGCACCTTGGAATTCCCATGCCATGCATTCCAGCATTCGAGGATCC<br>TGGAGTCATCCCCGCTCTCCAGGAAGGCGACAGCAGACTCGGAACCCAGCCCCAGATCCAC<br>TAGACCTGGGCAGTACTGAATAGCCCTAAGCTCTCTTTTCTCGTCGGAAAAATGGGCATGTAA<br>GTTGCCAAACGGAGTCATTCAGTGAGCTCGGGCTGGGCATAAAAGTCAGGGCAGAGCCATC<br>TATTGCTTACATTTGCTTCTGGGATCCAGATCTTTCGAAGCTAGCGCTACCGGTCGCCACCAT<br>GGTGAGCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACCTACGG<br>CAAGCTGACCCTGAAGCTGATCTGCACCACCGGCAAGCTGCCCGTGCCCTGGCCCACCCTC<br>GTGACCACCCTGGGCTACGGCGTGCAGTGCTTCGCCCGCTACCCCGACCACATGAAGCAGC<br>ACGACTTCTTCAAGTCCGCCATGCCCGAAGGCTACGTCCAGGAGCGCACCATCTTCTTCAAG<br>GACGACGGCAACTACAAGACCCGCGCCGAGGTGAAGTTCGAGGGCGACACCCTGGTGAAC<br>CGCATCGAGCTGAAGGGCATCGACTTCAAGGAGGACGGCAACATCCTGGGGCACAAGCTGG<br>AGTACAACTACAACAGCCACAACGTCTATATCACCGCCGACAAGCAGAAGAACGGCATCAAG<br>GCCAACTTCAAGATCCGCCACAACATCGAGGACGGCGGCGTGCAGCTCGCCGACCACTACC<br>AGCAGAACACCCCCATCGGCGACGGCCCCGTGCTGCTGCCCGACAACCACTACCTGAGCTA |

| Fig 26 cont'd |
|---|
| Vector ID (length between ITRs) & Sequence Between ITRs |
| CCAGTCCAAGCTGAGCAAAGACCCCAACGAGAAGCGCGATCACATGGTCCTGCTGGAGTTC GTGACCGCCGCCGGGATCACTCTCGGCATGGACGAGCTGTACAAGTAAGTCGACGGCGCG CCGCGGCCGCGAATTCGATATCATAATCAACCTCTGGATTACAAAATTTGTGAAAGATTGACT GGTATTCTTAACTATGTTGCTCCTTTTACGCTATGTGGATACGCTGCTTTAATGCCTTTGTATC ATGCTATTGCTTCCCGTATGGCTTTCATTTTCTCCTCCTTGTATAAATCCTGGTTAGTTCTTGC CACGGCGGAACTCATCGCCGCCTGCCTTGCCCGCTGCTGGACAGGGGCTCGGCTGTTGGG CACTGACAATTCCGTGGCTCGAGAGATCTTCGACTGTGCCTTCTAGTTGCCAGCCATCTGTT GTTTGCCCCTCCCCCGTGCCTTCCTTGACCCTGGAAGGTGCCACTCCCACTGTCCTTTCCTA ATAAAATGAGGAAATTGCATCGCATTGTCTGAGTAGGTGTCATTCTATTCTGGGGGGTGGGG TGGGGCAGGACAGCAAGGGGGAGGATTGGGAAGACAATAGCAGGCATGAGATCTCACGTG CGGACCGAGCGGCCGC (SEQ ID NO: 243) |
| CN2161 (1640) GCGGCCGCACGCGTTCCCTGTCCGTGACATCACTTGAAAAGCCCAACAAAGCTCGCACTCG TTTAGATTTCACATCTAGAATAGTATCTGTATAACCCACCTCCTGTAGATACCTGTGTGAAGAG AATCCTTAGAGTTCAGTCATACTGGAATCAGTATTCTATAATTTAATATGTAAATAAAAGTATTT ATTTAAACTCATTGCCTGCATAAGACTTAACAGTACAGTACTATGCTAGTAAGACTTGTTAATA AATAATCTTCCAGCTGCAGATGGAGCTGTCTCTTGCAGTACCGAGCTCGGGCTGGGCATAAA AGTCAGGGCAGAGCCATCTATTGCTTACATTTGCTTCTGGGATCCAGATCTTTCGAAGCTAGC GCTACCGGTCGCCACCATGGTGAGCAAGGGCGAGGAGCTGTTCACCGGGGTGGTGCCCAT CCTGGTCGAGCTGGACGGCGACGTAAACGGCCACAAGTTCAGCGTGTCCGGCGAGGGCGA GGGCGATGCCACCTACGGCAAGCTGACCCTGAAGCTGATCTGCACCACCGGCAAGCTGCCC GTGCCCTGGCCCACCCTCGTGACCACCCTGGGCTACGGCGTGCAGTGCTTCGCCCGCTACC CCGACCACATGAAGCAGCACGACTTCTTCAAGTCCGCCATGCCCGAAGGCTACGTCCAGGA GCGCACCATCTTCTTCAAGGACGACGGCAACTACAAGACCCGCGCCGAGGTGAAGTTCGAG GGCGACACCCTGGTGAACCGCATCGAGCTGAAGGGCATCGACTTCAAGGAGGACGGCAACA TCCTGGGGCACAAGCTGGAGTACAACTACAACAGCCACAACGTCTATATCACCGCCGACAAG CAGAAGAACGGCATCAAGGCCAACTTCAAGATCCGCCACAACATCGAGGACGGCGGCGTGC AGCTCGCCGACCACTACCAGCAGAACACCCCCATCGGCGACGGCCCCGTGCTGCTGCCCG ACAACCACTACCTGAGCTACCAGTCCAAGCTGAGCAAAGACCCCAACGAGAAGCGCGATCA CATGGTCCTGCTGGAGTTCGTGACCGCCGCCGGGATCACTCTCGGCATGGACGAGCTGTAC AAGTAAGTCGACGGCGCGCCGCGGCCGCGAATTCGATATCATAATCAACCTCTGGATTACAA AATTTGTGAAAGATTGACTGGTATTCTTAACTATGTTGCTCCTTTTACGCTATGTGGATACGCT GCTTTAATGCCTTTGTATCATGCTATTGCTTCCCGTATGGCTTTCATTTTCTCCTCCTTGTATA AATCCTGGTTAGTTCTTGCCACGGCGGAACTCATCGCCGCCTGCCTTGCCCGCTGCTGGACA GGGGCTCGGCTGTTGGGCACTGACAATTCCGTGGCTCGAGAGATCTTCGACTGTGCCTTCTA GTTGCCAGCCATCTGTTGTTTGCCCCTCCCCCGTGCCTTCCTTGACCCTGGAAGGTGCCACT CCCACTGTCCTTTCCTAATAAAATGAGGAAATTGCATCGCATTGTCTGAGTAGGTGTCATTCT ATTCTGGGGGGTGGGGTGGGGCAGGACAGCAAGGGGGAGGATTGGGAAGACAATAGCAGG CATGAGATCTCACGTGCGGACCGAGCGGCCGC (SEQ ID NO: 244) |
| CN2162 (1776) GCGGCCGCACGCGTGTGCTTATGTTGATTACTTCTTTCAGCTGAATAGGGAATAAGGCCTCA AAAGGTTTATATCCAGTATTTGAGTACTTTTGTTATTCTCTTTAAAAAGTCAGTATTAGGCACTA CTGGTTACTACCAGCTGAAGCCTTACACAGCTGTGTATTTAGCATTTAATCATGCTAAGAATT GCTAATTAGAAAATCAAACCGGACAAAGCATACCCAGTGGAGTTGATACAATACCATTTCTGT TTGAGAACCATAAATAAATAATCTTTACGCATTAGTGTTTCATTATAAGCATTTGTGCTGAATGT GGCAATATTTAACAAAATGTTTTAACTCACTAGAAATAATTTCTTGATATTATCCTTTCACAGAA ATCCGTAATCTCTTTAAAATATAGCCAGCCTTATCAAAATTAAGTTTCAGAGCTCGGGCTGGG CATAAAAGTCAGGGCAGAGCCATCTATTGCTTACATTTGCTTCTGGGATCCAGATCTTTCGAA GCTAGCGCTACCGGTCGCCACCATGGTGAGCAAGGGCGAGGAGCTGTTCACCGGGGTGGT |

| Fig 26 cont'd |
|---|
| Vector ID (length between ITRs) & Sequence Between ITRs |
| GCCCATCCTGGTCGAGCTGGACGGCGACGTAAACGGCCACAAGTTCAGCGTGTCCGGCGA<br>GGGCGAGGGCGATGCCACCTACGGCAAGCTGACCCTGAAGCTGATCTGCACCACCGGCAA<br>GCTGCCCGTGCCCTGGCCCACCCTCGTGACCACCCTGGGCTACGGCGTGCAGTGCTTCGC<br>CCGCTACCCCGACCACATGAAGCAGCACGACTTCTTCAAGTCCGCCATGCCCGAAGGCTAC<br>GTCCAGGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATATCACCG<br>CCGACAAGCAGAAGAACGGCATCAAGGCCAACTTCAAGATCCGCCACAACATCGAGGACGG<br>CGGCGTGCAGCTCGCCGACCACTACCAGCAGAACACCCCCATCGGCGACGGCCCCGTGCT<br>GCTGCCCGACAACCACTACCTGAGCTACCAGTCCAAGCTGAGCAAAGACCCCAACGAGAAG<br>CGCGATCACATGGTCCTGCTGGAGTTCGTGACCGCCGCCGGGATCACTCTCGGCATGGACG<br>AGCTGTACAAGTAAGTCGACGGCGCGCCGCGGCCGCGAATTCGATATCATAATCAACCTCTG<br>GATTACAAAATTTGTGAAAGATTGACTGGTATTCTTAACTATGTTGCTCCTTTTACGCTATGTG<br>GATACGCTGCTTTAATGCCTTTGTATCATGCTATTGCTTCCCGTATGGCTTTCATTTTCTCCTC<br>CTTGTATAAATCCTGGTTAGTTCTTGCCACGGCGGAACTCATCGCCGCCTGCCTTGCCCGCT<br>GCTGGACAGGGGCTCGGCTGTTGGGCACTGACAATTCCGTGGCTCGAGAGATCTTCGACTG<br>TGCCTTCTAGTTGCCAGCCATCTGTTGTTTGCCCCTCCCCCGTGCCTTCCTTGACCCTGGAA<br>GGTGCCACTCCCACTGTCCTTTCCTAATAAAATGAGGAAATTGCATCGCATTGTCTGAGTAGG<br>TGTCATTCTATTCTGGGGGGTGGGGTGGGGCAGGACAGCAAGGGGGAGGATTGGGAAGAC<br>AATAGCAGGCATGAGATCTCACGTGCGGACCGAGCGGCCGC (SEQ ID NO: 245) |
| CN2163 (1743)<br>GCGGCCGCACGCGTGGCAGCTCAGCAGTGGGTTAGCTGGGGCCTGCACACAGTAGGTGCT<br>CAGTAAGTGCTTGCTGAGTGTTACTGGTGTTTTGTTCATTCTTTCTCTTCATCCTGCCCCACC<br>CTGCCCTGGCTGCTCTTTGCTCATTGTATGATCCTTTTCATGAGAGAGTGTTTTGAAGAGCGC<br>AGACAGAATCTTAACAAATAGCGCATTGTCCCAGCGATCCAAAGCAGGACTGCAGTGCCGGG<br>GTGGCCCAAGGCTGCGGGGAAGAGGCTGGAGAGAGCAAGGCCTGCCGGACAGTGGCAGAT<br>CTCTAAGGAAATTGTCCCCTGGGGGTTGTGGTTCTTCCCATCAGAATCAGGCCTTTTGTTCTC<br>AGGAATGAGGTGGGCTAAGAGAGAGTTGGAGCTCGGGCTGGGCATAAAAGTCAGGGCAGA<br>GCCATCTATTGCTTACATTTGCTTCTGGGATCCAGATCTTTCGAAGCTAGCGCTACCGGTCGC<br>CACCATGGTGAGCAAGGGCGAGGAGCTGTTCACCGGGGTGGTGCCCATCCTGGTCGAGCT<br>GGACGGCGACGTAAACGGCCACAAGTTCAGCGTGTCCGGCGAGGGCGAGGGCGATGCCAC<br>CTACGGCAAGCTGACCCTGAAGCTGATCTGCACCACCGGCAAGCTGCCCGTGCCCTGGCCC<br>ACCCTCGTGACCACCCTGGGCTACGGCGTGCAGTGCTTCGCCCGCTACCCCGACCACATGA<br>AGCAGCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGACACCCTG<br>GTGAACCGCATCGAGCTGAAGGGCATCGACTTCAAGGAGGACGGCAACATCCTGGGGCACA<br>AGCTGGAGTACAACTACAACAGCCACAACGTCTATATCACCGCCGACAAGCAGAAGAACGGC<br>ATCAAGGCCAACTTCAAGATCCGCCACAACATCGAGGACGGCGGCGTGCAGCTCGCCGACC<br>ACTACCAGCAGAACACCCCCATCGGCGACGGCCCCGTGCTGCTGCCCGACAACCACTACCT<br>GAGCTACCAGTCCAAGCTGAGCAAAGACCCCAACGAGAAGCGCGATCACATGGTCCTGCTG<br>GAGTTCGTGACCGCCGCCGGGATCACTCTCGGCATGGACGAGCTGTACAAGTAAGTCGACG<br>GCGCGCCGCGGCCGCGAATTCGATATCATAATCAACCTCTGGATTACAAAATTTGTGAAAGA<br>TTGACTGGTATTCTTAACTATGTTGCTCCTTTTACGCTATGTGGATACGCTGCTTTAATGCCTT<br>TGTATCATGCTATTGCTTCCCGTATGGCTTTCATTTTCTCCTCCTTGTATAAATCCTGGTTAGT<br>TCTTGCCACGGCGGAACTCATCGCCGCCTGCCTTGCCCGCTGCTGGACAGGGGCTCGGCTG<br>TTGGGCACTGACAATTCCGTGGCTCGAGAGATCTTCGACTGTGCCTTCTAGTTGCCAGCCAT<br>CTGTTGTTTGCCCCTCCCCCGTGCCTTCCTTGACCCTGGAAGGTGCCACTCCCACTGTCCTT<br>TCCTAATAAAATGAGGAAATTGCATCGCATTGTCTGAGTAGGTGTCATTCTATTCTGGGGGGT |

| Fig 26 cont'd |
|---|
| Vector ID (length between ITRs) & Sequence Between ITRs |
| GGGGTGGGGCAGGACAGCAAGGGGGAGGATTGGGAAGACAATAGCAGGCATGAGATCTCA CGTGCGGACCGAGCGGCCGC (SEQ ID NO: 246) |
| CN2164(1762)<br>GCGGCCGCACGCGTGAAGACAGACAGCTGAGGTAGGATACAAAAGAGCTATTGATGGCTTT TGTCTATGTCAGACAGAAGCCTAAGGGAAGGGTGACTGCTCTCGCCTGGTGTCATGGATGTC ACATGATAGAAAGTTTTATGTTTGTTTCTGACATTAGGCAAACAAAAACCTTTTGAGGGCTGAA TTAGGCTTTTGTTTTGAGCCTGCAAGCTGCTACTCATTCCTATTGATGAGTACTGATCTGATTT CAGCCTTTTCATTTTTATGGTGTTAACTGTGTGGGGAATGTGTGTAGAAGGCCGGACACAGG ACCACCGACCCCATCTCCCTTGAGTTCACATATCTTTTGGAATTTCCTTTTTTTTTCTTTTCTTT TTTTGTTTCGTTTCAGGAGGGGGGCTGTCTCAGGAGCTTCGAGCTCGGGCTGGGCATAAAAG TCAGGGCAGAGCCATCTATTGCTTACATTTGCTTCTGGGATCCAGATCTTTCGAAGCTAGCGC TACCGGTCGCCACCATGGTGAGCAAGGGCGAGGAGCTGTTCACCGGGGTGGTGCCCATCCT GGTCGAGCTGGACGGCGACGTAAACGGCCACAAGTTCAGCGTGTCCGGCGAGGGCGAGGG CGATGCCACCTACGGCAAGCTGACCCTGAAGCTGATCTGCACCACCGGCAAGCTGCCCGTG CCCTGGCCCACCCTCGTGACCACCCTGGGCTACGGCGTGCAGTGCTTCGCCCGCTACCCCG ACCACATGAAGCAGCACGACTTCTTCAAGTCCGCCATGCCCGAAGGCTACGTCCAGGAGCG CACCATCTTCTTCAAGGACGACGGCAACTACAAGACCCGCGCCGAGGTGAAGTTCGAGGGC GACACCCTGGTGAACCGCATCGAGCTGAAGGGCATCGACTTCAAGGAGGACGGCAACATCC TGGGGCACAAGCTGGAGTACAACTACAACAGCCACAACGTCTATATCACCGCCGACAAGCAG AAGAACGGCATCAAGGCCAACTTCAAGATCCGCCACAACATCGAGGACGGCGGCGTGCAGC TCGCCGACCACTACCAGCAGAACACCCCCATCGGCGACGGCCCCGTGCTGCTGCCCGACAA CCACTACCTGAGCTACCAGTCCAAGCTGAGCAAAGACCCCAACGAGAAGCGCGATCACATG GTCCTGCTGGAGTTCGTGACCGCCGCCGGGATCACTCTCGGCATGGACGAGCTGTACAAGT AAGTCGACGGCGCGCCGCGGCCGCGAATTCGATATCATAATCAACCTCTGGATTACAAAATT TGTGAAAGATTGACTGGTATTCTTAACTATGTTGCTCCTTTTACGCTATGTGGATACGCTGCTT TAATGCCTTTGTATCATGCTATTGCTTCCCGTATGGCTTTCATTTTCTCCTCCTTGTATAAATC CTGGTTAGTTCTTGCCACGGCGGAACTCATCGCCGCCTGCCTTGCCCGCTGCTGGACAGGG GCTCGGCTGTTGGGCACTGACAATTCCGTGGCTCGAGAGATCTTCGACTGTGCCTTCTAGTT GCCAGCCATCTGTTGTTTGCCCCTCCCCCGTGCCTTCCTTGACCCTGGAAGGTGCCACTCCC ACTGTCCTTTCCTAATAAAATGAGGAAATTGCATCGCATTGTCTGAGTAGGTGTCATTCTATTC TGGGGGGTGGGGTGGGGCAGGACAGCAAGGGGGAGGATTGGGAAGACAATAGCAGGCATG AGATCTCACGTGCGGACCGAGCGGCCGC (SEQ ID NO: 247) |
| CN2165 (1750)<br>GCGGCCGCACGCGTTTGGTGTTGTCCTCTGGCCCAGCCCTGCCCAGGAACAGGAGACAGAC GGCCACACAGAGCCTTGCCTCTGATAACTGGGGGGTGGAGAGGTTGAGAAACAACGCTTCA CTCAGCAACTTCCTGCTCCCTCCGAGGAAGAAGAAAGGGGTGTCTGTGCTAGAGCCACTCC CTTGCCAGCAGCCCAGCAGAACAGCTGCTGATCCCCTGCATCCCCACGTCCCGGCGGAGGC CCTGGGAAGTGGGAACATCAGCTGGAGAGAAAAGGAGAAAGCAGTACATTGAGTGTTGCTTA GGCCGCCTGCTTCGCTTTCTTCTCGCTCTCCCCAGAGACAATCTCGTGGCCTGTGTTTCC CCGCAGGCAGGCCCCAGCGCCCTCAAGCCCAGATGTCTGAGCTCGGGCTGGGCATAAAAGT CAGGGCAGAGCCATCTATTGCTTACATTTGCTTCTGGGATCCAGATCTTTCGAAGCTAGCGCT ACCGGTCGCCACCATGGTGAGCAAGGGCGAGGAGCTGTTCACCGGGGTGGTGCCCATCCT GGTCGAGCTGGACGGCGACGTAAACGGCCACAAGTTCAGCGTGTCCGGCGAGGGCGAGGG CGATGCCACCTACGGCAAGCTGACCCTGAAGCTGATCTGCACCACCGGCAAGCTGCCCGTG CCCTGGCCCACCCTCGTGACCACCCTGGGCTACGGCGTGCAGTGCTTCGCCCGCTACCCCG ACCACATGAAGCAGCACGACTTCTTCAAGTCCGCCATGCCCGAAGGCTACGTCCAGGAGCG CACCATCTTCTTCAAGGACGACGGCAACTACAAGACCCGCGCCGAGGTGAAGTTCGAGGGC GACACCCTGGTGAACCGCATCGAGCTGAAGGGCATCGACTTCAAGGAGGACGGCAACATCC TGGGGCACAAGCTGGAGTACAACTACAACAGCCACAACGTCTATATCACCGCCGACAAGCAG |

| Fig 26 cont'd |
| --- |
| Vector ID (length between ITRs) & Sequence Between ITRs |
| AAGAACGGCATCAAGGCCAACTTCAAGATCCGCCACAACATCGAGGACGGCGGCGTGCAGC<br>TCGCCGACCACTACCAGCAGAACACCCCCATCGGCGACGGCCCCGTGCTGCTGCCCGACAA<br>CCACTACCTGAGCTACCAGTCCAAGCTGAGCAAAGACCCCAACGAGAAGCGCGATCACATG<br>GTCCTGCTGGAGTTCGTGACCGCCGCCGGGATCACTCTCGGCATGGACGAGCTGTACAAGT<br>AAGTCGACGGCGCGCCGCGGCCGCGAATTCGATATCATAATCAACCTCTGGATTACAAAATT<br>TGTGAAAGATTGACTGGTATTCTTAACTATGTTGCTCCTTTTACGCTATGTGGATACGCTGCTT<br>TAATGCCTTTGTATCATGCTATTGCTTCCCGTATGGCTTTCATTTTCTCCTCCTTGTATAAATC<br>CTGGTTAGTTCTTGCCACGGCGGAACTCATCGCCGCCTGCCTTGCCCGCTGCTGGACAGGG<br>GCTCGGCTGTTGGGCACTGACAATTCCGTGGCTCGAGAGATCTTCGACTGTGCCTTCTAGTT<br>GCCAGCCATCTGTTGTTTGCCCCTCCCCCGTGCCTTCCTTGACCCTGGAAGGTGCCACTCCC<br>ACTGTCCTTTCCTAATAAAATGAGGAAATTGCATCGCATTGTCTGAGTAGGTGTCATTCTATTC<br>TGGGGGGTGGGGTGGGGCAGGACAGCAAGGGGGAGGATTGGGAAGACAATAGCAGGCATG<br>AGATCTCACGTGCGGACCGAGCGGCCGC (SEQ ID NO: 248) |
| CN2166 (1712)<br>GCGGCCGCACGCGTACCTGGACCAAATCTGCTGATTCAGTGCTCTGGGCTCTCTCCACTTCA<br>TCACCCTCATTGGCAAGTAGTCGACTGGGCGGGTTGTTCAAAGCGTGCCCTCCTCAGCTTCT<br>AGACCCTCCCATTCATGCCATGTCCAGATGACATCTCCCTGAACACAATGCTCCCTCTCAGAC<br>ACATTTGGATGGAATTATGCCTGGCCTGAATGGGAACCTTGTCTGCTTTCTAGGTTTCTCCCA<br>GACAGGGGTAATGTTTCTAGAGTCCATTTACTAGGAGCAGCATGATGGGACTGGGGATGTCC<br>CTTTAAAAATTAAAAGTTAAGTTTCTCTTTAAGTGCCAGGATTGAGTGGATTTGGGGAGCTCG<br>GGCTGGGCATAAAAGTCAGGGCAGAGCCATCTATTGCTTACATTTGCTTCTGGGATCCAGAT<br>CTTTCGAAGCTAGCGCTACCGGTCGCCACCATGGTGAGCAAGGGCGAGGAGCTGTTCACCG<br>GGGTGGTGCCCATCCTGGTCGAGCTGGACGGCGACGTAAACGGCCACAAGTTCAGCGTGTC<br>CGGCGAGGGCGAGGGCGATGCCACCTACGGCAAGCTGACCCTGAAGCTGATCTGCACCAC<br>CGGCAAGCTGCCCGTGCCCTGGCCCACCCTCGTGACCACCCTGGGCTACGGCGTGCAGTG<br>CTTCGCCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAACGTCTAT<br>ATCACCGCCGACAAGCAGAAGAACGGCATCAAGGCCAACTTCAAGATCCGCCACAACATCGA<br>GGACGGCGGCGTGCAGCTCGCCGACCACTACCAGCAGAACACCCCCATCGGCGACGGCCCC<br>CGTGCTGCTGCCCGACAACCACTACCTGAGCTACCAGTCCAAGCTGAGCAAAGACCCCAAC<br>GAGAAGCGCGATCACATGGTCCTGCTGGAGTTCGTGACCGCCGCCGGGATCACTCTCGGCA<br>TGGACGAGCTGTACAAGTAAGTCGACGGCGCGCCGCGGCCGCGAATTCGATATCATAATCA<br>ACCTCTGGATTACAAAATTTGTGAAAGATTGACTGGTATTCTTAACTATGTTGCTCCTTTTACG<br>CTATGTGGATACGCTGCTTTAATGCCTTTGTATCATGCTATTGCTTCCCGTATGGCTTTCATTT<br>TCTCCTCCTTGTATAAATCCTGGTTAGTTCTTGCCACGGCGGAACTCATCGCCGCCTGCCTTG<br>CCCGCTGCTGGACAGGGGCTCGGCTGTTGGGCACTGACAATTCCGTGGCTCGAGAGATCTT<br>CGACTGTGCCTTCTAGTTGCCAGCCATCTGTTGTTTGCCCCTCCCCCGTGCCTTCCTTGACC<br>CTGGAAGGTGCCACTCCCACTGTCCTTTCCTAATAAAATGAGGAAATTGCATCGCATTGTCTG<br>AGTAGGTGTCATTCTATTCTGGGGGGTGGGGTGGGGCAGGACAGCAAGGGGGAGGATTGG<br>GAAGACAATAGCAGGCATGAGATCTCACGTGCGGACCGAGCGGCCGC (SEQ ID NO: 249) |
| CN2167 (1622)<br>GCGGCCGCACGCGTTACTGCTTTGCTCCCCAGCCCAGGTGTCACCACCCAGTCAATCAGAA<br>AGTCAAAGAGTCTGAGGGCAGTGGAGGGAGGTTGTGCCTGGCCCAGAGGGTTTTAAGTGTG<br>AACTGGATTGAGAACAACATGCCGATTGTTCTTTGTTTGCTGAGACTGGCTTGGTGCCAGCG<br>CAGAACTGGCTGGCCCTGAGAAGCTTACAGAGCCTAGTGACCAGGTGTGGGGAACCAGCAC<br>TGGCTGCGGGGGTGGGGGTAGAAGGGAGCACAGGAGCTCGGGCTGGGCATAAAAGTCAGG<br>GCAGAGCCATCTATTGCTTACATTTGCTTCTGGGATCCAGATCTTTCGAAGCTAGCGCTACCG |

| Fig 26 cont'd |
| :-- |
| Vector ID (length between ITRs) & Sequence Between ITRs |
| GTCGCCACCATGGTGAGCAAGGGCGAGGAGCTGTTCACCGGGGTGGTGCCCATCCTGGTC GAGCTGGACGGCGACGTAAACGGCCACAAGTTCAGCGTGTCCGGCGAGGGCGAGGGCGAT GCCACCTACGGCAAGCTGACCCTGAAGCTGATCTGCACCACCGGCAAGCTGCCCGTGCCCT GGCCCACCCTCGTGACCACCCTGGGCTACGGCGTGCAGTGCTTCGCCCGCTACCCCGACCA CATGAAGCAGCACGACTTCTTCAAGTCCGCCATGCCCGAAGGCTACGTCCAGGAGCGCACC ATCTTCTTCAAGGACGACGGCAACTACAAGACCCGCGCCGAGGTGAAGTTCGAGGGCGACA CCCTGGTGAACCGCATCGAGCTGAAGGGCATCGACTTCAAGGAGGACGGCAACATCCTGGG GCACAAGCTGGAGTACAACTACAACAGCCACAACGTCTATATCACCGCCGACAAGCAGAAGA ACGGCATCAAGGCCAACTTCAAGATCCGCCACAACATCGAGGACGGCGGCGTGCAGCTCGC CGACCACTACCAGCAGAACACCCCCATCGGCGACGGCCCCGTGCTGCTGCCCGACAACCAC TACCTGAGCTACCAGTCCAAGCTGAGCAAAGACCCCAACGAGAAGCGCGATCACATGGTCCT GCTGGAGTTCGTGACCGCCGCCGGGATCACTCTCGGCATGGACGAGCTGTACAAGTAAGTC GACGGCGCGCCGCGGCCGCGAATTCGATATCATAATCAACCTCTGGATTACAAAATTTGTGA AAGATTGACTGGTATTCTTAACTATGTTGCTCCTTTTACGCTATGTGGATACGCTGCTTTAATG CCTTTGTATCATGCTATTGCTTCCCGTATGGCTTTCATTTTCTCCTCCTTGTATAAATCCTGGT TAGTTCTTGCCACGGCGGAACTCATCGCCGCCTGCCTTGCCCGCTGCTGGACAGGGGCTCG GCTGTTGGGCACTGACAATTCCGTGGCTCGAGAGATCTTCGACTGTGCCTTCTAGTTGCCAG CCATCTGTTGTTTGCCCCTCCCCCGTGCCTTCCTTGACCCTGGAAGGTGCCACTCCCACTGT CCTTTCCTAATAAAATGAGGAAATTGCATCGCATTGTCTGAGTAGGTGTCATTCTATTCTGGG GGGTGGGGTGGGGCAGGACAGCAAGGGGGAGGATTGGGAAGACAATAGCAGGCATGAGAT CTCACGTGCGGACCGAGCGGCCGC (SEQ ID NO: 250) |
| CN2168 (1962) GCGGCCGCACGCGTAGCTTTTGGTAAGACACTAAACTGTCTCGAAGACTAGACAGGAAGGAA AACCTTGAATTACTCTCACATAATTCCACTCCAGATATCTCAACAGCAATGCATACAAAAAGCT CCTATTACTCCCTCAAAAGGGCATCTGAGACCGAGAATACTTAGAAATGTGTGCAGCGTGTG ATAATGTGGTACACTGAAGAACAAAAGGGCAAAAGAAAAATGAGGCTTTAACAGGCACAATAT CTAGGTCATTTATCCTTGGTTAATGGGTAGAAAAACACAATGCGGTAGTGTCAGCAAGGGAC ACAAAGGCACTCTGGTGTCCTGCAGACCAGCGCTCGATGCCAGAAACCAGGGTGTGGAAAA ACCCATGTGGAATTGAAACAGACCCACTTAAGCACGCACGCGCGCACGCACGGTCTCAGGA GCTACTGATTTGTGGACCCCTTTTTGACCTTTGGTATTTAAAGTAAAATATAATTTGAGATCTA CTGTTTTCACCTTTTTATGTCACCTGAACCAACACAAAGCCATATTTCCATCCAGTTAAAAAGC AGGGGAAGGGATGTGGACGAGAGTGTTTCGTGTGTGTTGCCTTCCTCCACACCCTGAGCTC GGGCTGGGCATAAAAGTCAGGGCAGAGCCATCTATTGCTTACATTTGCTTCTGGGATCCAGA TCTTTCGAAGCTAGCGCTACCGGTCGCCACCATGGTGAGCAAGGGCGAGGAGCTGTTCACC GGGGTGGTGCCCATCCTGGTCGAGCTGGACGGCGACGTAAACGGCCACAAGTTCAGCGTGT CCGGCGAGGGCGAGGGCGATGCCACCTACGGCAAGCTGACCCTGAAGCTGATCTGCACCA CCGGCAAGCTGCCCGTGCCCTGGCCCACCCTCGTGACCACCCTGGGCTACGGCGTGCAGT GCTTCGCCCGCTACCCCGACCACATGAAGCAGCACGACTTCTTCAAGTCCGCCATGCCCGA AGGCTACGTCCAGGAGCGCACCATCTTCTTCAAGGACGACGGCAACTACAAGACCCGCGCC GAGGTGAAGTTCGAGGGCGACACCCTGGTGAACCGCATCGAGCTGAAGGGCATCGACTTCA AGGAGGACGGCAACATCCTGGGGCACAAGCTGGAGTACAACTACAACAGCCACAACGTCTA TATCACCGCCGACAAGCAGAAGAACGGCATCAAGGCCAACTTCAAGATCCGCCACAACATCG AGGACGGCGGCGTGCAGCTCGCCGACCACTACCAGCAGAACACCCCCATCGGCGACGGCC CCGTGCTGCTGCCCGACAACCACTACCTGAGCTACCAGTCCAAGCTGAGCAAAGACCCCAA CGAGAAGCGCGATCACATGGTCCTGCTGGAGTTCGTGACCGCCGCCGGGATCACTCTCGGC ATGGACGAGCTGTACAAGTAAGTCGACGGCGCGCCGCGGCCGCGAATTCGATATCATAATC AACCTCTGGATTACAAAATTTGTGAAAGATTGACTGGTATTCTTAACTATGTTGCTCCTTTTAC GCTATGTGGATACGCTGCTTTAATGCCTTTGTATCATGCTATTGCTTCCCGTATGGCTTTCATT TTCTCCTCCTTGTATAAATCCTGGTTAGTTCTTGCCACGGCGGAACTCATCGCCGCCTGCCTT |

| Fig 26 cont'd |
|---|
| Vector ID (length between ITRs) & Sequence Between ITRs |
| GCCCGCTGCTGGACAGGGGCTCGGCTGTTGGGCACTGACAATTCCGTGGCTCGAGAGATCT TCGACTGTGCCTTCTAGTTGCCAGCCATCTGTTGTTTGCCCCTCCCCCGTGCCTTCCTTGAC CCTGGAAGGTGCCACTCCCACTGTCCTTTCCTAATAAAATGAGGAAATTGCATCGCATTGTCT GAGTAGGTGTCATTCTATTCTGGGGGGTGGGGTGGGGCAGGACAGCAAGGGGGAGGATTG GGAAGACAATAGCAGGCATGAGATCTCACGTGCGGACCGAGCGGCCGC (SEQ ID NO: 251) |
| CN2169 (1747)<br>GCGGCCGCACGCGTGAGACGGGGACTTCTAGCCCCCAGCTGGAGCCTGGGGCTGGGGAAG GAGGAACCTGAGGTTAGGGTGCTGGAGGATGAGACAGCTGCAGGAAGCCCCCCTCCCCCAT CCACACGTCACACCCACCGCTCCTTGGGCCTGGGCTTAGGAGAAAAAAGGGGAAACTGGAT TCTGGTCACAGGGCAGATGCCCAGTGGCCTGTGGGGGAAGGGAGGAGAGGAGATTTGGAG CCTGGAGGAGGGTCAGGTCCCAGCTCAGCCCACGGTCACCACTGTTCAGGCCTGGCTGAGT CCCCTCCCTTAAAAACCCAAGCCTCTCCCATTGTGTCTAGAGCGAGCATGGAGGGAACAGAC CCTGTAGGTCCTCCCGGGCACACCAGGCCACCCAATGTGAGCTCGGGCTGGGCATAAAAGT CAGGGCAGAGCCATCTATTGCTTACATTTGCTTCTGGGATCCAGATCTTTCGAAGCTAGCGCT ACCGGTCGCCACCATGGTGAGCAAGGGCGAGGAGCTGTTCACCGGGGTGGTGCCCATCCT GGTCGAGCTGGACGGCGACGTAAACGGCCACAAGTTCAGCGTGTCCGGCGAGGGCGAGGG CGATGCCACCTACGGCAAGCTGACCCTGAAGCTGATCTGCACCACCGGCAAGCTGCCCGTG CCCTGGCCCACCCTCGTGACCACCCTGGGCTACGGCGTGCAGTGCTTCGCCCGCTACCCCG ACCACATGAAGCAGCACGACTTCTTCAAGTCCGCCATGCCCGAAGGCTACGTCCAGGAGCG CACCATCTTCTTCAAGGACGACGGCAACTACAAGACCCGCGCCGAGGTGAAGTTCGAGGGC GACACCCTGGTGAACCGCATCGAGCTGAAGGGCATCGACTTCAAGGAGGACGGCAACATCC TGGGGCACAAGCTGGAGTACAACTACAACAGCCACAACGTCTATATCACCGCCGACAAGCAG AAGAACGGCATCAAGGCCAACTTCAAGATCCGCCACAACATCGAGGACGGCGGCGTGCAGC TCGCCGACCACTACCAGCAGAACACCCCCATCGGCGACGGCCCCGTGCTGCTGCCCGACAA CCACTACCTGAGCTACCAGTCCAAGCTGAGCAAAGACCCCAACGAGAAGCGCGATCACATG GTCCTGCTGGAGTTCGTGACCGCCGCCGGGATCACTCTCGGCATGGACGAGCTGTACAAGT AAGTCGACGGCGCGCCGCGGCCGCGAATTCGATATCATAATCAACCTCTGGATTACAAAATT TGTGAAAGATTGACTGGTATTCTTAACTATGTTGCTCCTTTTACGCTATGTGGATACGCTGCTT TAATGCCTTTGTATCATGCTATTGCTTCCCGTATGGCTTTCATTTTCTCCTCCTTGTATAAATC CTGGTTAGTTCTTGCCACGGCGGAACTCATCGCCGCCTGCCTTGCCCGCTGCTGGACAGGG GCTCGGCTGTTGGGCACTGACAATTCCGTGGCTCGAGAGATCTTCGACTGTGCCTTCTAGTT GCCAGCCATCTGTTGTTTGCCCCTCCCCCGTGCCTTCCTTGACCCTGGAAGGTGCCACTCCC ACTGTCCTTTCCTAATAAAATGAGGAAATTGCATCGCATTGTCTGAGTAGGTGTCATTCTATTC TGGGGGGTGGGGTGGGGCAGGACAGCAAGGGGGAGGATTGGGAAGACAATAGCAGGCATG AGATCTCACGTGCGGACCGAGCGGCCGC (SEQ ID NO: 252) |
| CN2170 (1798)<br>GCGGCCGCACGCGTGAAGGCATAGCTGGAGGGCACAGGGGCTGGGGCCACTGTCGGAGC ATCCAGAGTGAAGTGATACACAGGAGGACAGGGAGTGGCTCGGAGGTGAGGAGGCCTGGC CGCTGACCATCCCAGCCAAGCGTGAGGAAAGATGCGTCAGCGTTTCTGGTGAGGTCAGCAA TCAGTGACGTCCCTCTCACCAGCAGGAAAAGCTTGCAACATGGCCCAGCCAGTATAAATAGG CTCCCCGACCACAGGACCCGGGCTGTCCCCTCTTCCCGGGCCACGTCAGCCAGGCCCGCG TGATTTGGAGAGGAAGAGAGGACCAGCTTGGTTCCTCAGAACTGCTGCTTCCTCGCTTTCCG GCTTACCCTCTGCTGTGGGGCCCTACGCCTTTAAATGCAAGGATAGGACCTGAGATGGCCTG GCAGGGCCAGGTCGAAACTGGAGGCTGGGAGCTCGGGCTGGGCATAAAAGTCAGGGCAGA GCCATCTATTGCTTACATTTGCTTCTGGGATCCAGATCTTTCGAAGCTAGCGCTACCGGTCGC CACCATGGTGAGCAAGGGCGAGGAGCTGTTCACCGGGGTGGTGCCCATCCTGGTCGAGCT GGACGGCGACGTAAACGGCCACAAGTTCAGCGTGTCCGGCGAGGGCGAGGGCGATGCCAC CTACGGCAAGCTGACCCTGAAGCTGATCTGCACCACCGGCAAGCTGCCCGTGCCCTGGCCC ACCCTCGTGACCACCCTGGGCTACGGCGTGCAGTGCTTCGCCCGCTACCCCGACCACATGA |

| Fig 26 cont'd |
| --- |
| Vector ID (length between ITRs) & Sequence Between ITRs |
| AGCAGCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGACACCCTG<br>GTGAACCGCATCGAGCTGAAGGGCATCGACTTCAAGGAGGACGGCAACATCCTGGGGCACA<br>AGCTGGAGTACAACTACAACAGCCACAACGTCTATATCACCGCCGACAAGCAGAAGAACGGC<br>ATCAAGGCCAACTTCAAGATCCGCCACAACATCGAGGACGGCGGCGTGCAGCTCGCCGACC<br>ACTACCAGCAGAACACCCCCATCGGCGACGGCCCCGTGCTGCTGCCCGACAACCACTACCT<br>GAGCTACCAGTCCAAGCTGAGCAAAGACCCCAACGAGAAGCGCGATCACATGGTCCTGCTG<br>GAGTTCGTGACCGCCGCCGGGATCACTCTCGGCATGGACGAGCTGTACAAGTAAGTCGACG<br>GCGCGCCGCGGCCGCGAATTCGATATCATAATCAACCTCTGGATTACAAAATTTGTGAAAGA<br>TTGACTGGTATTCTTAACTATGTTGCTCCTTTTACGCTATGTGGATACGCTGCTTTAATGCCTT<br>TGTATCATGCTATTGCTTCCCGTATGGCTTTCATTTTCTCCTCCTTGTATAAATCCTGGTTAGT<br>TCTTGCCACGGCGGAACTCATCGCCGCCTGCCTTGCCCGCTGCTGGACAGGGGCTCGGCTG<br>TTGGGCACTGACAATTCCGTGGCTCGAGAGATCTTCGACTGTGCCTTCTAGTTGCCAGCCAT<br>CTGTTGTTTGCCCCTCCCCCGTGCCTTCCTTGACCCTGGAAGGTGCCACTCCCACTGTCCTT<br>TCCTAATAAAATGAGGAAATTGCATCGCATTGTCTGAGTAGGTGTCATTCTATTCTGGGGGGT<br>GGGGTGGGGCAGGACAGCAAGGGGGAGGATTGGGAAGACAATAGCAGGCATGAGATCTCA<br>CGTGCGGACCGAGCGGCCGC (SEQ ID NO: 253) |
| CN2171 (2050)<br>GCGGCCGCACGCGTCCAGGCTGGTCCTTCCTGTCTCACTGAGGTCTCAGACCTCATGCTCA<br>TTGGGACTTGGCTGAACTCCAGGCCGTCAGCCCAACAGCGCTAAAGCTACAGCCAAGCCGC<br>AGAGAGCCGTGGCCTCCCACGCCCCACGTTGCTGGGCAGAGAAGGGAAGCATTTCAGACAG<br>GCAGGCTGGCCCCTGGCCAGCAGGTCTCCAGATGCCATGCAACACACACCTGAGCAGGGTA<br>AGAGAATAGGTGTGTGTCAACAGTATTTGAAAAAGAAAATAGCTGCACAAATACAGCACTTGT<br>TAACACAGGTGTTTACAGGTGGAATTATTTTTCCAGGGCTGCTATCTCCCAGCCTTCTTTGTG<br>CTTCTCAGCTCACACCTGCAGGGACTTTCCTACGAAGCCAAGGCACAAAGGGGAAGTGGATA<br>GTCCGTATCAATTTTACCACGGAGGAGGTCAGCGATCGGCTTCAGGCCTGGCTAGTTTTCAC<br>AGTTTCCCTTGCTGGACTCACTTCCATGTTTTCAACCTGCTCTAACAGGATCTGGCCTGCGCT<br>CCACTTCCTGCTTGGCTAAGGCAGCTGCTGTGACCACCCCAGGCAGTCACAGCAAGAAGCC<br>ATTTCCTGGGGCCAGGGCACGCTGGCTACTCTCGGGACATAATTATCTATCTGGTCCTTGTC<br>TCCTCTCCCCCAGGAGAGGCTCAATGGAGCTCGGGCTGGGCATAAAAGTCAGGGCAGAGCC<br>ATCTATTGCTTACATTTGCTTCTGGGATCCAGATCTTTCGAAGCTAGCGCTACCGGTCGCCAC<br>CATGGTGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCCACCTA<br>CGGCAAGCTGACCCTGAAGCTGATCTGCACCACCGGCAAGCTGCCCGTGCCCTGGCCCACC<br>CTCGTGACCACCCTGGGCTACGGCGTGCAGTGCTTCGCCCGCTACCCCGACCACATGAAGC<br>AGCACGACTTCTTCAAGTCCGCCATGCCCGAAGGCTACGTCCAGGAGCGCACCATCTTCTTC<br>AAGGACGACGGCAACTACAAGACCCGCGCCGAGGTGAAGTTCGAGGGCGACACCCTGGTG<br>AACCGCATCGAGCTGAAGGGCATCGACTTCAAGGAGGACGGCAACATCCTGGGGCACAAGC<br>TGGAGTACAACTACAACAGCCACAACGTCTATATCACCGCCGACAAGCAGAAGAACGGCATC<br>AAGGCCAACTTCAAGATCCGCCACAACATCGAGGACGGCGGCGTGCAGCTCGCCGACCACT<br>ACCAGCAGAACACCCCCATCGGCGACGGCCCCGTGCTGCTGCCCGACAACCACTACCTGAG<br>CTACCAGTCCAAGCTGAGCAAAGACCCCAACGAGAAGCGCGATCACATGGTCCTGCTGGAG<br>TTCGTGACCGCCGCCGGGATCACTCTCGGCATGGACGAGCTGTACAAGTAAGTCGACGGCG<br>CGCCGCGGCCGCGAATTCGATATCATAATCAACCTCTGGATTACAAAATTTGTGAAAGATTGA<br>CTGGTATTCTTAACTATGTTGCTCCTTTTACGCTATGTGGATACGCTGCTTTAATGCCTTTGTA<br>TCATGCTATTGCTTCCCGTATGGCTTTCATTTTCTCCTCCTTGTATAAATCCTGGTTAGTTCTT<br>GCCACGGCGGAACTCATCGCCGCCTGCCTTGCCCGCTGCTGGACAGGGGCTCGGCTGTTG<br>GGCACTGACAATTCCGTGGCTCGAGAGATCTTCGACTGTGCCTTCTAGTTGCCAGCCATCTG<br>TTGTTTGCCCCTCCCCCGTGCCTTCCTTGACCCTGGAAGGTGCCACTCCCACTGTCCTTTCC |

| Fig 26 cont'd |
| :--- |
| Vector ID (length between ITRs) & Sequence Between ITRs |
| TAATAAAATGAGGAAATTGCATCGCATTGTCTGAGTAGGTGTCATTCTATTCTGGGGGGTGGG<br>GTGGGGCAGGACAGCAAGGGGGAGGATTGGGAAGACAATAGCAGGCATGAGATCTCACGT<br>GCGGACCGAGCGGCCGC (SEQ ID NO: 254) |
| CN2172 (1828)<br>GCGGCCGCACGCGGACTTTTATGCCCAGCCCGAGCTCGCCATCACTACTGCCAGGCAGCAG<br>CCAGCCCACCAGAGCCTGGCCCTGGTGGCAACCAGTTAGCCTCTGTGACCTCCCCATCTGA<br>CTCCATCTTCCCCCTCTGCTGTGGACCTTGTCTAATTTCTACCCACTTCAGAGACTAGGACAA<br>AGATGGCATCTCCAAGGCATTCTCTTCTCCAAGCTGAAGACCCCTGTGTCTGGGAGGGGCTG<br>GGAGGTGAGGTGGGGCCTTCCTGGAGGATACTAAAAGGGCTCCTAACCCTGGTGTCTCTTC<br>CCTCCCAGCCTGTCCCTCTTATGCCACTCATGGCATCAATCCGTCCAGAGGGACACTCCGAT<br>GACTCACCCACCACAGCACTTTCACTTCCTTCTTCTCCAGAGGAGGCGTCTGACCTGCTGCA<br>GCTGCACTGAAGGGCCTCTTCTCAGGGGCTTCCAAGGCACGCGTGCGGCCGCAGGAACGG<br>GCTGGGCATAAAAGTCAGGGCAGAGCCATCTATTGCTTACATTTGCTTCTGGGATCCAGATC<br>TTTCGAAGCTAGCGCTACCGGTCGCCACCATGGTGAGCAAGGGCGAGGAGCTGTTCACCGG<br>GGTGGTGCCCATCCTGGTCGAGCTGGACGGCGACGTAAACGGCCACAAGTTCAGCGTGTCC<br>GGCGAGGGCGAGGGCGATGCCACCTACGGCAAGCTGACCCTGAAGCTGATCTGCACCACC<br>GGCAAGCTGCCCGTGCCCTGGCCCACCCTCGTGACCACCCTGGGCTACGGCGTGCAGTGC<br>TTCGCCCGCTACCCCGACCACATGAAGCAGCACGACTTCTTCAAGTCCGCCATGCCCGAAG<br>GCTACGTCCAGGAGCGCACCATCTTCTTCAAGGACGACGGCAACTACAAGACCCGCGCCGA<br>GGTGAAGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGTCTATAT<br>CACCGCCGACAAGCAGAAGAACGGCATCAAGGCCAACTTCAAGATCCGCCACAACATCGAG<br>GACGGCGGCGTGCAGCTCGCCGACCACTACCAGCAGAACACCCCCATCGGCGACGGCCCC<br>GTGCTGCTGCCCGACAACCACTACCTGAGCTACCAGTCCAAGCTGAGCAAAGACCCCAACG<br>AGAAGCGCGATCACATGGTCCTGCTGGAGTTCGTGACCGCCGCCGGGATCACTCTCGGCAT<br>GGACGAGCTGTACAAGTAAGTCGACGGCGCGCCGCGGCCGCGAATTCGATATCATAATCAA<br>CCTCTGGATTACAAAATTTGTGAAAGATTGACTGGTATTCTTAACTATGTTGCTCCTTTTACGC<br>TATGTGGATACGCTGCTTTAATGCCTTTGTATCATGCTATTGCTTCCCGTATGGCTTTCATTTT<br>CTCCTCCTTGTATAAATCCTGGTTAGTTCTTGCCACGGCGGAACTCATCGCCGCCTGCCTTG<br>CCCGCTGCTGGACAGGGGCTCGGCTGTTGGGCACTGACAATTCCGTGGCTCGAGAGATCTT<br>CGACTGTGCCTTCTAGTTGCCAGCCATCTGTTGTTTGCCCCTCCCCCGTGCCTTCCTTGACC<br>CTGGAAGGTGCCACTCCCACTGTCCTTTCCTAATAAAATGAGGAAATTGCATCGCATTGTCTG<br>AGTAGGTGTCATTCTATTCTGGGGGGTGGGGTGGGGCAGGACAGCAAGGGGGAGGATTGG<br>GAAGACAATAGCAGGCATGAGATCTCACGTGCGGACCGAGCGGCCGC (SEQ ID NO: 255) |
| CN2173 (1714)<br>GCGGCCGCACGCGTGTGGGATGCCTCCATGAGCTCCAACAGGCAGCCTCGCCGACCTCCC<br>AGCTCTGCTCAGTTGCTCAGCACCCCATGGAGAAGGTGAAGCCCATAATGAACACACTGCCC<br>TGGCCACTTACTTCCTCCAACCAAAGAAGCCCTCATCTCCCGGGCCTAGACCATTTCCGGAG<br>ACCAGCTTGTGACAGAGCCACAACCTCCGGTCACTCTGTCAGCTATCTGCAGTTCCTCCTTTT<br>TCCTTTCCTCTCTCCCCTCATAAACAATGACTGTTGATGTTTCCACTAGCTACAGATGCTGATG<br>CCAAGATTAGCTTTGGTCAAGATGATATTCTCCATCCTCCAAAACAATGACCAAAATGTGAGC<br>TCGGGCTGGGCATAAAAGTCAGGGCAGAGCCATCTATTGCTTACATTTGCTTCTGGGATCCA<br>GATCTTTCGAAGCTAGCGCTACCGGTCGCCACCATGGTGAGCAAGGGCGAGGAGCTGTTCA<br>CCGGGGTGGTGCCCATCCTGGTCGAGCTGGACGGCGACGTAAACGGCCACAAGTTCAGCG<br>TGTCCGGCGAGGGCGAGGGCGATGCCACCTACGGCAAGCTGACCCTGAAGCTGATCTGCA<br>CCACCGGCAAGCTGCCCGTGCCCTGGCCCACCCTCGTGACCACCCTGGGCTACGGCGTGC<br>AGTGCTTCGCCCGCTACCCCGACCACATGAAGCAGCACGACTTCTTCAAGTCCGCCATGCCC<br>GAAGGCTACGTCCAGGAGCGCACCATCTTCTTCAAGGACGACGGCAACTACAAGACCCGCG<br>CCGAGGTGAAGTTCGAGGGCGACACCCTGGTGAACCGCATCGAGCTGAAGGGCATCGACTT |

| Fig 26 cont'd |
| --- |
| Vector ID (length between ITRs) & Sequence Between ITRs |

CAAGGAGGACGGCAACATCCTGGGGCACAAGCTGGAGTACAACTACAACAGCCACAACGTC
TATATCACCGCCGACAAGCAGAAGAACGGCATCAAGGCCAACTTCAAGATCCGCCACAACAT
CGAGGACGGCGGCGTGCAGCTCGCCGACCACTACCAGCAGAACACCCCCATCGGCGACGG
CCCCGTGCTGCTGCCCGACAACCACTACCTGAGCTACCAGTCCAAGCTGAGCAAAGACCCC
AACGAGAAGCGCGATCACATGGTCCTGCTGGAGTTCGTGACCGCCGCCGGGATCACTCTCG
GCATGGACGAGCTGTACAAGTAAGTCGACGGCGCGCCGCGGCCGCGAATTCGATATCATAA
TCAACCTCTGGATTACAAAATTTGTGAAAGATTGACTGGTATTCTTAACTATGTTGCTCCTTTT
ACGCTATGTGGATACGCTGCTTTAATGCCTTTGTATCATGCTATTGCTTCCCGTATGGCTTTC
ATTTTCTCCTCCTTGTATAAATCCTGGTTAGTTCTTGCCACGGCGGAACTCATCGCCGCCTGC
CTTGCCCGCTGCTGGACAGGGGCTCGGCTGTTGGGCACTGACAATTCCGTGGCTCGAGAGA
TCTTCGACTGTGCCTTCTAGTTGCCAGCCATCTGTTGTTTGCCCCTCCCCCGTGCCTTCCTTG
ACCCTGGAAGGTGCCACTCCCACTGTCCTTTCCTAATAAAATGAGGAAATTGCATCGCATTGT
CTGAGTAGGTGTCATTCTATTCTGGGGGGTGGGGTGGGGCAGGACAGCAAGGGGGAGGATT
GGGAAGACAATAGCAGGCATGAGATCTCACGTGCGGACCGAGCGGCCGC (SEQ ID NO: 256)

CN2174 (1791)
GCGGCCGCACGCGTAGCAACATTCTGTGTGAAAAGCCATGATGACAAATGAATGAGGTATAT
CCTAGGGTTATCAGTGAAAATCATCATAGTTTGCACTGTCAGCCTGAGTGTGCAGAGGTCCA
CAGCAGGACTGCCCCACACAGGAAGAAGACACAGAGAGGAATCTCTTACTACTTGCTTGCCT
AATCATTTCCACTTAACACACAGTGAAAGCAGAACTTCGTGACATGCTTGCCCTGTCTGGGCA
AAGGTTCTGCTTTTTTAGGAAGATCTTGGAAAAAGAAAAAAAAAAACAAATAACAAAAAGTCCC
CCAAAACTTGGCCATGAGTGGGGAAGAGCTTCTCAATCTTTCATTTATTCCACTAGCATCTGT
AGTCAGTTTCTTCATCCTCGTGCCATGTATCCACGTGCCTGGCACTGTGCTGGGGACTGAGA
CCTGCGTACGAGCTCGGGCTGGGCATAAAAGTCAGGGCAGAGCCATCTATTGCTTACATTTG
CTTCTGGGATCCAGATCTTTCGAAGCTAGCGCTACCGGTCGCCACCATGGTGAGCAAGGGC
GAGGAGCTGTTCACCGGGGTGGTGCCCATCCTGGTCGAGCTGGACGGCGACGTAAACGGC
CACAAGTTCAGCGTGTCCGGCGAGGGCGAGGGCGATGCCACCTACGGCAAGCTGACCCTG
AAGCTGATCTGCACCACCGGCAAGCTGCCCGTGCCCTGGCCCACCCTCGTGACCACCCTGG
GCTACGGCGTGCAGTGCTTCGCCCGCTACCCCGACCACATGAAGCAGCACGACTTCTTCAA
GTCCGCCATGCCCGAAGGCTACGTCCAGGAGCGCACCATCTTCTTCAAGGACGACGGCAAC
TACAAGACCCGCGCCGAGGTGAAGTTCGAGGGCGACACCCTGGTGAACCGCATCGAGCTGA
AGGGCATCGACTTCAAGGAGGACGGCAACATCCTGGGGCACAAGCTGGAGTACAACTACAA
CAGCCACAACGTCTATATCACCGCCGACAAGCAGAAGAACGGCATCAAGGCCAACTTCAAGA
TCCGCCACAACATCGAGGACGGCGGCGTGCAGCTCGCCGACCACTACCAGCAGAACACCCC
CATCGGCGACGGCCCCGTGCTGCTGCCCGACAACCACTACCTGAGCTACCAGTCCAAGCTG
AGCAAAGACCCCAACGAGAAGCGCGATCACATGGTCCTGCTGGAGTTCGTGACCGCCGCCG
GGATCACTCTCGGCATGGACGAGCTGTACAAGTAAGTCGACGGCGCGCCGCGGCCGCGAAT
TCGATATCATAATCAACCTCTGGATTACAAAATTTGTGAAAGATTGACTGGTATTCTTAACTAT
GTTGCTCCTTTTACGCTATGTGGATACGCTGCTTTAATGCCTTTGTATCATGCTATTGCTTCCC
GTATGGCTTTCATTTTCTCCTCCTTGTATAAATCCTGGTTAGTTCTTGCCACGGCGGAACTCAT
CGCCGCCTGCCTTGCCCGCTGCTGGACAGGGGCTCGGCTGTTGGGCACTGACAATTCCGTG
GCTCGAGAGATCTTCGACTGTGCCTTCTAGTTGCCAGCCATCTGTTGTTTGCCCCTCCCCCG
TGCCTTCCTTGACCCTGGAAGGTGCCACTCCCACTGTCCTTTCCTAATAAAATGAGGAAATTG
CATCGCATTGTCTGAGTAGGTGTCATTCTATTCTGGGGGGTGGGGTGGGGCAGGACAGCAA
GGGGGAGGATTGGGAAGACAATAGCAGGCATGAGATCTCACGTGCGGACCGAGCGGCCGC
(SEQ ID NO: 257)

CN2175 (1918)
GCGGCCGCACGCGTTCATTTCCAGGGGCCACAGCCAAGCCCAGAGTCCCCCAGCGGCTCG
CATGTCAGCCCAGACCCCAGGGTCCTTGGCCTAGGAGAGGAGCAGTGGAGGGGCCCAGGC
TCTGAGCTCCACAGGTCTGAGCAGGGAGCAACTCAGGCCCCCACCCAAGCCTGCGTCAGCG

| Fig 26 cont'd |
| --- |
| Vector ID (length between ITRs) & Sequence Between ITRs |

GAACTTGAGTGAGGGGCGTTGTGCAATTTGTGGCAAGGCTGGCCCAGCTGGATGCCTGGGT
CCCAGTATTTTTAGCCCCAAAGGAGAAGTGAAAAGGCCCCAGCCGGGGTGAATCATCAGTCC
TGGGGAAGAACCCAGGCGCCTGAGCCCCAGCTCCGGGAAGCAGGCACTGGGGAGGGGGC
TTCAAGGAGGGAGTGCCCCCTCAGACTCCCTGCTTCCCTGGAAGCTTCAGGAAGCTCAGCC
TCAGCCTTCAGGCCTGAGCAAGTGCAGGGCGGAGCTACCAGCCCAGGCTCAGATGTTGGGG
TGTGAAAGCCTCAAGTGACTCAGCCTGGTTGGAGAACTGCCCCACCCAGTATCTTCTGTGCC
ATGGTTCCCACATTCGCACTCCATGGCGAGCTCGGGCTGGGCATAAAAGTCAGGGCAGAGC
CATCTATTGCTTACATTTGCTTCTGGGATCCAGATCTTTCGAAGCTAGCGCTACCGGTCGCCA
CCATGGTGAGCAAGGGCGAGGAGCTGTTCACCGGGGTGGTGCCCATCCTGGTCGAGCTGG
ACGGCGACGTAAACGGCCACAAGTTCAGCGTGTCCGGCGAGGGCGAGGGCGATGCCACCT
ACGGCAAGCTGACCCTGAAGCTGATCTGCACCACCGGCAAGCTGCCCGTGCCCTGGCCCAC
CCTCGTGACCACCCTGGGCTACGGCGTGCAGTGCTTCGCCCGCTACCCCGACCACATGAAG
CAGCACGACTTCTTCAAGTCCGCCATGCCCGAAGGCTACGTCCAGGAGCGCACCATCTTCTT
CAAGGACGACGGCAACTACAAGACCCGCGCCGAGGTGAAGTTCGAGGGCGACACCCTGGT
GAACCGCATCGAGCTGAAGGGCATCGACTTCAAGGAGGACGGCAACATCCTGGGGCACAAG
CTGGAGTACAACTACAACAGCCACAACGTCTATATCACCGCCGACAAGCAGAAGAACGGCAT
CAAGGCCAACTTCAAGATCCGCCACAACATCGAGGACGGCGGCGTGCAGCTCGCCGACCAC
TACCAGCAGAACACCCCCATCGGCGACGGCCCCGTGCTGCTGCCCGACAACCACTACCTGA
GCTACCAGTCCAAGCTGAGCAAAGACCCCAACGAGAAGCGCGATCACATGGTCCTGCTGGA
GTTCGTGACCGCCGCCGGGATCACTCTCGGCATGGACGAGCTGTACAAGTAAGTCGACGGC
GCGCCGCGGCCGCGAATTCGATATCATAATCAACCTCTGGATTACAAAATTTGTGAAAGATTG
ACTGGTATTCTTAACTATGTTGCTCCTTTTACGCTATGTGGATACGCTGCTTTAATGCCTTTGT
ATCATGCTATTGCTTCCCGTATGGCTTTCATTTTCTCCTCCTTGTATAAATCCTGGTTAGTTCT
TGCCACGGCGGAACTCATCGCCGCCTGCCTTGCCCGCTGCTGGACAGGGGCTCGGCTGTT
GGGCACTGACAATTCCGTGGCTCGAGAGATCTTCGACTGTGCCTTCTAGTTGCCAGCCATCT
GTTGTTTGCCCCTCCCCCGTGCCTTCCTTGACCCTGGAAGGTGCCACTCCCACTGTCCTTTC
CTAATAAAATGAGGAAATTGCATCGCATTGTCTGAGTAGGTGTCATTCTATTCTGGGGGGTGG
GGTGGGGCAGGACAGCAAGGGGGAGGATTGGGAAGACAATAGCAGGCATGAGATCTCACG
TGCGGACCGAGCGGCCGC (SEQ ID NO: 258)

---

CN2176 (1827)
GCGGCCGCACGCGTAGTTGCTGAGCCCAGTCTGGGTGGTGCTCCTCCCAGGCTCCCGGAA
GCCCCACTCCATAGGTGCAGGCTTACAGACTTCCCTAACAACTGCTGCAGGCCACAACCTCA
AACTCACAGCAAACAGGAAGCAGGAGGTGCTGTCACATGTAACACAGTCAGAGCTTCAAGCC
CCCGGAAAAGCTCAATGCCAGATTTCATTCTCTGCCCCTGATGATGCCCCGCACTTTCTTAAC
TATGCAGCTCAGAATCTCTCTGTTTCTCACGCAGAGACCAAGGACACCATCTGCCCTACACTC
ACCCCAGGAAAGCATTGTTGGTAACATTCCTGAAATTTAGTCATCCAACCTCTGCTAGACTAT
TTCTAGAAGGCAGCAAACCCAGCAGGCCTTCAGGGACAATGTGGACAGAGTCTGCTCCCTCT
TTCACATCTCATTTTGTCTCCTCTTCTGCAAGCTAAACTACCCTGGCTGAGCTCGGGCTGGGC
ATAAAAGTCAGGGCAGAGCCATCTATTGCTTACATTTGCTTCTGGGATCCAGATCTTTCGAAG
CTAGCGCTACCGGTCGCCACCATGGTGAGCAAGGGCGAGGAGCTGTTCACCGGGGTGGTG
CCCATCCTGGTCGAGCTGGACGGCGACGTAAACGGCCACAAGTTCAGCGTGTCCGGCGAG
GGCGAGGGCGATGCCACCTACGGCAAGCTGACCCTGAAGCTGATCTGCACCACCGGCAAG
CTGCCCGTGCCCTGGCCCACCCTCGTGACCACCCTGGGCTACGGCGTGCAGTGCTTCGCCC
GCTACCCCGACCACATGAAGCAGCACGACTTCTTCAAGTCCGCCATGCCCGAAGGCTACGT
CCAGGAGCGCACCATCTTCTTCAAGGACGACGGCAACTACAAGACCCGCGCCGAGGTGAAG
TTCGAGGGCGACACCCTGGTGAACCGCATCGAGCTGAAGGGCATCGACTTCAAGGAGGACG
GCAACATCCTGGGGCACAAGCTGGAGTACAACTACAACAGCCACAACGTCTATATCACCGCC
GACAAGCAGAAGAACGGCATCAAGGCCAACTTCAAGATCCGCCACAACATCGAGGACGGCG
GCGTGCAGCTCGCCGACCACTACCAGCAGAACACCCCCATCGGCGACGGCCCCGTGCTGC

| Fig 26 cont'd |
| :--- |
| Vector ID (length between ITRs) & Sequence Between ITRs |
| TGCCCGACAACCACTACCTGAGCTACCAGTCCAAGCTGAGCAAAGACCCCAACGAGAAGCG CGATCACATGGTCCTGCTGGAGTTCGTGACCGCCGCCGGGATCACTCTCGGCATGGACGAG CTGTACAAGTAAGTCGACGGCGCGCCGCGGCCGCGAATTCGATATCATAATCAACCTCTGGA TTACAAAATTTGTGAAAGATTGACTGGTATTCTTAACTATGTTGCTCCTTTTACGCTATGTGGA TACGCTGCTTTAATGCCTTTGTATCATGCTATTGCTTCCCGTATGGCTTTCATTTTCTCCTCCT TGTATAAATCCTGGTTAGTTCTTGCCACGGCGGAACTCATCGCCGCCTGCCTTGCCCGCTGC TGGACAGGGGCTCGGCTGTTGGGCACTGACAATTCCGTGGCTCGAGAGATCTTCGACTGTG CCTTCTAGTTGCCAGCCATCTGTTGTTTGCCCCTCCCCCGTGCCTTCCTTGACCCTGGAAGG TGCCACTCCCACTGTCCTTTCCTAATAAAATGAGGAAATTGCATCGCATTGTCTGAGTAGGTG TCATTCTATTCTGGGGGGTGGGGTGGGGCAGGACAGCAAGGGGGAGGATTGGGAAGACAAT AGCAGGCATGAGATCTCACGTGCGGACCGAGCGGCCGC (SEQ ID NO: 259) |
| CN2177 (1737) GCGGCCGCACGCGTCTGAGCTCCAGGAAGGCCACAGCTCTTAGGCGCATGACCCACACCA GGAGGTTTCAGTCTAGACAGGAGCTGGGAAGAACTTAAGCCCCTGGGCCAATCAGCAGGGG AGGAGGCCCAGCCTGTGGTTCCAAACACCAGGTCTTACTCAGTGTCCCCAACCACAAGCCAC AGGTGAGTCAGCATGCCACTTCCCGAGCTGGGTCCCACTCCACGCCCTCACTTCTGTTCTTA GAAAAGGACGACCAGGCAATCTTGTAAAACCTTTGCTTCCCATTACTCGGCCCACACAGTCA CCTGTGTGGCCTCTTTAGCTACATGAATCTTGCTCACCACCTTCAGCTTTTCATGCCAGCCAG CTGCCTGCCCCTTACACGTTCCTGAGCTCGGGCTGGGCATAAAAGTCAGGGCAGAGCCATC TATTGCTTACATTTGCTTCTGGGATCCAGATCTTTCGAAGCTAGCGCTACCGGTCGCCACCAT GGTGAGCAAGGGCGAGGAGCTGTTCACCGGGGTGGTGCCCATCCTGGTCGAGCTGGACGG CGACGTAAACGGCCACAAGTTCAGCGTGTCCGGCGAGGGCGAGGGCGATGCCACCTACGG CAAGCTGACCCTGAAGCTGATCTGCACCACCGGCAAGCTGCCCGTGCCCTGGCCCACCCTC GTGACCACCCTGGGCTACGGCGTGCAGTGCTTCGCCCGCTACCCCGACCACATGAAGCAGC ACGACTTCTTCAAGTCCGCCATGCCCGAAGGCTACGTCCAGGAGCGCACCATCTTCTTCAAG GACGACGGCAACTACAAGACCCGCGCCGAGGTGAAGTTCGAGGGCGACACCCTGGTGAAC CGCATCGAGCTGAAGGGCATCGACTTCAAGGAGGACGGCAACATCCTGGGGCACAAGCTGG AGTACAACTACAACAGCCACAACGTCTATATCACCGCCGACAAGCAGAAGAACGGCATCAAG GCCAACTTCAAGATCCGCCACAACATCGAGGACGGCGGCGTGCAGCTCGCCGACCACTACC AGCAGAACACCCCCATCGGCGACGGCCCCGTGCTGCTGCCCGACAACCACTACCTGAGCTA CCAGTCCAAGCTGAGCAAAGACCCCAACGAGAAGCGCGATCACATGGTCCTGCTGGAGTTC GTGACCGCCGCCGGGATCACTCTCGGCATGGACGAGCTGTACAAGTAAGTCGACGGCGCG CCGCGGCCGCGAATTCGATATCATAATCAACCTCTGGATTACAAAATTTGTGAAAGATTGACT GGTATTCTTAACTATGTTGCTCCTTTTACGCTATGTGGATACGCTGCTTTAATGCCTTTGTATC ATGCTATTGCTTCCCGTATGGCTTTCATTTTCTCCTCCTTGTATAAATCCTGGTTAGTTCTTGC CACGGCGGAACTCATCGCCGCCTGCCTTGCCCGCTGCTGGACAGGGGCTCGGCTGTTGGG CACTGACAATTCCGTGGCTCGAGAGATCTTCGACTGTGCCTTCTAGTTGCCAGCCATCTGTT GTTTGCCCCTCCCCCGTGCCTTCCTTGACCCTGGAAGGTGCCACTCCCACTGTCCTTTCCTA ATAAAATGAGGAAATTGCATCGCATTGTCTGAGTAGGTGTCATTCTATTCTGGGGGGTGGGG TGGGGCAGGACAGCAAGGGGGAGGATTGGGAAGACAATAGCAGGCATGAGATCTCACGTG CGGACCGAGCGGCCGC (SEQ ID NO: 260) |
| CN2178 (1777) GCGGCCGCACGCGTCAGAGGCTTGGAGGAAGGGGCCTGCAGCTACCCAGCAGGGCAGGG CTGGGGTATGGACTTTGTGGTGACAGCAGATTAGTAAGCAAGAGATGGCCGTGATGCCTTGA AAAGAGGAACTCTTCAGTTTGGGCAGCTTCCTGGGTGTACGAGGAAAAGGAAGTGTCAAAAG TTCAGGCCTGAGGCACCCTTCCAGGCCCACTAGATGCCAGCATGGCTTAGGGAGGGCTGAC AGCGAGGCCTGGGGGCTGGTTGGAAGGAGGCAGGTTTGGAGGTGCTGAGCGGGCAGAAGA CACAATCGGATTCATTCATTCACCAGCAAATGTTTCCTGAGGAAGACACAGGAAGTCTTGTGT TTACACATTCACCTTCCTTGATCTGGCACAGACAAATCAGCACTCGCTGAGACAGCATCTGCC |

| Fig 26 cont'd |
|---|
| Vector ID (length between ITRs) & Sequence Between ITRs |
| CCAGAGCTCGGGCTGGGCATAAAAGTCAGGGCAGAGCCATCTATTGCTTACATTTGCTTCTG GGATCCAGATCTTTCGAAGCTAGCGCTACCGGTCGCCACCATGGTGAGCAAGGGCGAGGAG CTGTTCACCGGGGTGGTGCCCATCCTGGTCGAGCTGGACGGCGACGTAAACGGCCACAAGT TCAGCGTGTCCGGCGAGGGCGAGGGCGATGCCACCTACGGCAAGCTGACCCTGAAGCTGA TCTGCACCACCGGCAAGCTGCCCGTGCCCTGGCCCACCCTCGTGACCACCCTGGGCTACGG CGTGCAGTGCTTCGCCCGCTACCCCGACCACATGAAGCAGCACGACTTCTTCAAGTCCGCC ATGCCCGAAGGCTACGTCCAGGAGCGCACCATCTTCTTCAAGGACGACGGCAACTACAAGA CCCGCGCCGAGGTGAAGTTCGAGGGCGACACCCTGGTGAACCGCATCGAGCTGAAGGGCA TCGACTTCAAGGAGGACGGCAACATCCTGGGGCACAAGCTGGAGTACAACTACAACAGCCA CAACGTCTATATCACCGCCGACAAGCAGAAGAACGGCATCAAGGCCAACTTCAAGATCCGCC ACAACATCGAGGACGGCGGCGTGCAGCTCGCCGACCACTACCAGCAGAACACCCCCATCGG CGACGGCCCCGTGCTGCTGCCCGACAACCACTACCTGAGCTACCAGTCCAAGCTGAGCAAA GACCCCAACGAGAAGCGCGATCACATGGTCCTGCTGGAGTTCGTGACCGCCGCCGGGATCA CTCTCGGCATGGACGAGCTGTACAAGTAAGTCGACGGCGCGCCGCGGCCGCGAATTCGATA TCATAATCAACCTCTGGATTACAAAATTTGTGAAAGATTGACTGGTATTCTTAACTATGTTGCT CCTTTTACGCTATGTGGATACGCTGCTTTAATGCCTTTGTATCATGCTATTGCTTCCCGTATGG CTTTCATTTTCTCCTCCTTGTATAAATCCTGGTTAGTTCTTGCCACGGCGGAACTCATCGCCG CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCGC (SEQ ID NO: 261) |
| CN2179 (1673) GCGGCCGCACGCGTGGGCCTTGATCACCTCTGCTGAGTAGCTGACTGCGGGGCTGGGGCT CTGATGCTCAGGACCCACCTCTCTGGGACCCACAGTCTTTTTCCACTGTGGCGTGTAGTGAT GTCACAGGTGGCAGTGATGTCACTGTGGTTTGAGGTACTTGGCTGTGAGCCCCGGAGGAGG AAGTGTCTGTTCGCTGATGGGGGGGTTGGAAGAGATCATTGACTTCTGCCCCAAGCGTGAGCC CCAAGTGTGCAGGGGGGAGTGCGGGGGGGAGGGCTGTTGGCGGCGCATCCCAGGGCTCTG GCTCTGCCCTTGCATCTAGCCTGTCGAGCTCGGGCTGGGCATAAAAGTCAGGGCAGAGCCA TCTATTGCTTACATTTGCTTCTGGGATCCAGATCTTTCGAAGCTAGCGCTACCGGTCGCCACC ATGGTGAGCAAGGGCGAGGAGCTGTTCACCGGGGTGGTGCCCATCCTGGTCGAGCTGGAC GGCGACGTAAACGGCCACAAGTTCAGCGTGTCCGGCGAGGGCGAGGGCGATGCCACCTAC GGCAAGCTGACCCTGAAGCTGATCTGCACCACCGGCAAGCTGCCCGTGCCCTGGCCCACCC TCGTGACCACCCTGGGCTACGGCGTGCAGTGCTTCGCCCGCTACCCCGACCACATGAAGCA GCACGACTTCTTCAAGTCCGCCATGCCCGAAGGCTACGTCCAGGAGCGCACCATCTTCTTCA AGGACGACGGCAACTACAAGACCCGCGCCGAGGTGAAGTTCGAGGGCGACACCCTGGTGA ACCGCATCGAGCTGAAGGGCATCGACTTCAAGGAGGACGGCAACATCCTGGGGCACAAGCT GGAGTACAACTACAACAGCCACAACGTCTATATCACCGCCGACAAGCAGAAGAACGGCATCA AGGCCAACTTCAAGATCCGCCACAACATCGAGGACGGCGGCGTGCAGCTCGCCGACCACTA CCAGCAGAACACCCCCATCGGCGACGGCCCCGTGCTGCTGCCCGACAACCACTACCTGAGC TACCAGTCCAAGCTGAGCAAAGACCCCAACGAGAAGCGCGATCACATGGTCCTGCTGGAGT TCGTGACCGCCGCCGGGATCACTCTCGGCATGGACGAGCTGTACAAGTAAGTCGACGGCGC GCCGCGGCCGCGAATTCGATATCATAATCAACCTCTGGATTACAAAATTTGTGAAAGATTGAC TGGTATTCTTAACTATGTTGCTCCTTTTACGCTATGTGGATACGCTGCTTTAATGCCTTTGTAT CATGCTATTGCTTCCCGTATGGCTTTCATTTTCTCCTCCTTGTATAAATCCTGGTTAGTTCTTG CCACGGCGGAACTCATCGCCGCCTGCCTTGCCCGCTGCTGGACAGGGGCTCGGCTGTTGG GCACTGACAATTCCGTGGCTCGAGAGATCTTCGACTGTGCCTTCTAGTTGCCAGCCATCTGT TGTTTGCCCCTCCCCCGTGCCTTCCTTGACCCTGGAAGGTGCCACTCCCACTGTCCTTTCCT |

| Fig 26 cont'd |
|---|
| Vector ID (length between ITRs) & Sequence Between ITRs |
| AATAAAATGAGGAAATTGCATCGCATTGTCTGAGTAGGTGTCATTCTATTCTGGGGGGTGGG GTGGGGCAGGACAGCAAGGGGGAGGATTGGGAAGACAATAGCAGGCATGAGATCTCACGT GCGGACCGAGCGGCCGC (SEQ ID NO: 262) |
| CN2180 (1801)<br>GCGGCCGCACGCGTGCTGACAGCCTAGCCAGGTAAGTCTTGATGGGGAATAAGAGGGAAGA ACCCTGAAGCCACCCTGGCTGATGAGTGGCCAGAGGAATGCAAGCTACAAGACAAGGTTTG TAACCTCAAAAAGAACTACTGAGGTCAACTTCTCCTTTCTCCAAAGTTGGCTGGGCTTTTGGC TGCTTCAGAGGAGGTGACTCAGGGGAACTCCCACCCCTGGTGTGTTCTTTAGTTTCTCGAAA CTTATCATGGCTACTTCCCTATTCCAAAGCCCCGACCAGAGCAAATTATCTGTAGGGGAGAAC GATCTTCAATAGTGACACGAGAGTAACACAAAGGGGAGCAGGAAAATATGCACGAGAAGCCA CCTGCATGCCCTCCGGTCGTCCCCCTTGGTCCCATGGGGCCAAGCCTTGGTGGTCAGAACA CACAACGAAGGAAAGTCGCCCAGAGAGCTCGGGCTGGGCATAAAAGTCAGGGCAGAGCCAT CTATTGCTTACATTTGCTTCTGGGATCCAGATCTTTCGAAGCTAGCGCTACCGGTCGCCACCA TGGTGAGCAAGGGCGAGGAGCTGTTCACCGGGGTGGTGCCCATCCTGGTCGAGCTGGACG GCGACGTAAACGGCCACAAGTTCAGCGTGTCCGGCGAGGGCGAGGGCGATGCCACCTACG GCAAGCTGACCCTGAAGCTGATCTGCACCACCGGCAAGCTGCCCGTGCCCTGGCCCACCCT CGTGACCACCCTGGGCTACGGCGTGCAGTGCTTCGCCCGCTACCCCGACCACATGAAGCAG CACGACTTCTTCAAGTCCGCCATGCCCGAAGGCTACGTCCAGGAGCGCACCATCTTCTTCAA GGACGACGGCAACTACAAGACCCGCGCCGAGGTGAAGTTCGAGGGCGACACCCTGGTGAA CCGCATCGAGCTGAAGGGCATCGACTTCAAGGAGGACGGCAACATCCTGGGGCACAAGCTG GAGTACAACTACAACAGCCACAACGTCTATATCACCGCCGACAAGCAGAAGAACGGCATCAA GGCCAACTTCAAGATCCGCCACAACATCGAGGACGGCGGCGTGCAGCTCGCCGACCACTAC CAGCAGAACACCCCCATCGGCGACGGCCCCGTGCTGCTGCCCGACAACCACTACCTGAGCT ACCAGTCCAAGCTGAGCAAAGACCCCAACGAGAAGCGCGATCACATGGTCCTGCTGGAGTT CGTGACCGCCGCCGGGATCACTCTCGGCATGGACGAGCTGTACAAGTAAGTCGACGGCGC GCCGCGGCCGCGAATTCGATATCATAATCAACCTCTGGATTACAAAATTTGTGAAAGATTGAC TGGTATTCTTAACTATGTTGCTCCTTTTACGCTATGTGGATACGCTGCTTTAATGCCTTTGTAT CATGCTATTGCTTCCCGTATGGCTTTCATTTTCTCCTCCTTGTATAAATCCTGGTTAGTTCTTG CCACGGCGGAACTCATCGCCGCCTGCCTTGCCCGCTGCTGGACAGGGGCTCGGCTGTTGG GCACTGACAATTCCGTGGCTCGAGAGATCTTCGACTGTGCCTTCTAGTTGCCAGCCATCTGT TGTTTGCCCCTCCCCCGTGCCTTCCTTGACCCTGGAAGGTGCCACTCCCACTGTCCTTTCCT AATAAAATGAGGAAATTGCATCGCATTGTCTGAGTAGGTGTCATTCTATTCTGGGGGGTGGG GTGGGGCAGGACAGCAAGGGGGAGGATTGGGAAGACAATAGCAGGCATGAGATCTCACGT GCGGACCGAGCGGCCGC (SEQ ID NO: 263) |
| CN2181 (1703)<br>GCGGCCGCACGCGTCCTCCACCCAGACCAGCAGCCCAAGCCCCTAGAGGCCCCGAGCTGA GGAGCCCCAGTTGGGGCAGCAGTGAAGGTCCGGATCCTTACCTGAGGCTGCAGGGCGGAG GAGAGCTCGCCCTGTGCTCCAGGCTCCGAAGTGGGGTTCCCTTCAGGGAGGGCAGGGCTTA TAACCCCGAGGCCACGTGGGCCAGATCTCAGGGCGCCCAACGGTCTCAGAGCGCGCCCCG CCCCCGCCCGCAGGGGATGAGCGCCCTCCCTCCCTCCCTCCCTGGGGAGGACAGACTGAC AGGAAACAGAAGGGGGTGGGCCCGCGGGAGGGCTGGGGACCCTCTCATGCCCTGGGGA GCTCGGGCTGGGCATAAAAGTCAGGGCAGAGCCATCTATTGCTTACATTTGCTTCTGGGATC CAGATCTTTCGAAGCTAGCGCTACCGGTCGCCACCATGGTGAGCAAGGGCGAGGAGCTGTT CACCGGGGTGGTGCCCATCCTGGTCGAGCTGGACGGCGACGTAAACGGCCACAAGTTCAG CGTGTCCGGCGAGGGCGAGGGCGATGCCACCTACGGCAAGCTGACCCTGAAGCTGATCTG CACCACCGGCAAGCTGCCCGTGCCCTGGCCCACCCTCGTGACCACCCTGGGCTACGGCGT GCAGTGCTTCGCCCGCTACCCCGACCACATGAAGCAGCACGACTTCTTCAAGTCCGCCATG CCCGAAGGCTACGTCCAGGAGCGCACCATCTTCTTCAAGGACGACGGCAACTACAAGACCC GCGCCGAGGTGAAGTTCGAGGGCGACACCCTGGTGAACCGCATCGAGCTGAAGGGCATCG |

| Fig 26 cont'd |
| Vector ID (length between ITRs) & Sequence Between ITRs |
| --- |
| ACTTCAAGGAGGACGGCAACATCCTGGGGCACAAGCTGGAGTACAACTACAACAGCCACAA CGTCTATATCACCGCCGACAAGCAGAAGAACGGCATCAAGGCCAACTTCAAGATCCGCCACA ACATCGAGGACGGCGGCGTGCAGCTCGCCGACCACTACCAGCAGAACACCCCCATCGGCG ACGGCCCCGTGCTGCTGCCCGACAACCACTACCTGAGCTACCAGTCCAAGCTGAGCAAAGA CCCCAACGAGAAGCGCGATCACATGGTCCTGCTGGAGTTCGTGACCGCCGCCGGGATCACT CTCGGCATGGACGAGCTGTACAAGTAAGTCGACGGCGCGCCGCGGCCGCGAATTCGATATC ATAATCAACCTCTGGATTACAAAATTTGTGAAAGATTGACTGGTATTCTTAACTATGTTGCTCC TTTTACGCTATGTGGATACGCTGCTTTAATGCCTTTGTATCATGCTATTGCTTCCCGTATGGCT TTCATTTTCTCCTCCTTGTATAAATCCTGGTTAGTTCTTGCCACGGCGGAACTCATCGCCGCC TGCCTTGCCCGCTGCTGGACAGGGGCTCGGCTGTTGGGCACTGACAATTCCGTGGCTCGAG AGATCTTCGACTGTGCCTTCTAGTTGCCAGCCATCTGTTGTTTGCCCCTCCCCCGTGCCTTCC TTGACCCTGGAAGGTGCCACTCCCACTGTCCTTTCCTAATAAAATGAGGAAATTGCATCGCAT TGTCTGAGTAGGTGTCATTCTATTCTGGGGGGTGGGGTGGGGCAGGACAGCAAGGGGGAG GATTGGGAAGACAATAGCAGGCATGAGATCTCACGTGCGGACCGAGCGGCCGC (SEQ ID NO: 264) |
| CN2182 (1590) GCGGCCGCACGCGTCCTTGCATCTTTTAGCCGACCCATATGACTTACTCATTTTGTTTACTTC TTACTACTTCTCCAATTTTTATTTTGATTCTAATCTGGTCATTGAGAATGTGACTTCCTCTTCTT AGTTTTCGTTTCCCAGCTAGGTTTCATTTGCTGTGTCAGTGACTGTTTTTTTTTTTCTGGTAGT ATTAGTCATTGATAAAAAATGTTCTATAAGAAGATCGAGTCCAGGACCATACCTGAGCTCGGG CTGGGCATAAAAGTCAGGGCAGAGCCATCTATTGCTTACATTTGCTTCTGGGATCCAGATCTT TCGAAGCTAGCGCTACCGGTCGCCACCATGGTGAGCAAGGGCGAGGAGCTGTTCACCGGG GTGGTGCCCATCCTGGTCGAGCTGGACGGCGACGTAAACGGCCACAAGTTCAGCGTGTCCG GCGAGGGCGAGGGCGATGCCACCTACGGCAAGCTGACCCTGAAGCTGATCTGCACCACCG GCAAGCTGCCCGTGCCCTGGCCCACCCTCGTGACCACCCTGGGCTACGGCGTGCAGTGCTT CGCCCGCTACCCCGACCACATGAAGCAGCACGACTTCTTCAAGTCCGCCATGCCCGAAGGC TACGTCCAGGAGCGCACCATCTTCTTCAAGGACGACGGCAACTACAAGACCCGCGCCGAGG TGAAGTTCGAGGGCGACACCCTGGTGAACCGCATCGAGCTGAAGGGCATCGACTTCAAGGA GGACGGCAACATCCTGGGGCACAAGCTGGAGTACAACTACAACAGCCACAACGTCTATATCA CCGCCGACAAGCAGAAGAACGGCATCAAGGCCAACTTCAAGATCCGCCACAACATCGAGGA CGGCGGCGTGCAGCTCGCCGACCACTACCAGCAGAACACCCCCATCGGCGACGGCCCCGT GCTGCTGCCCGACAACCACTACCTGAGCTACCAGTCCAAGCTGAGCAAAGACCCCAACGAG AAGCGCGATCACATGGTCCTGCTGGAGTTCGTGACCGCCGCCGGGATCACTCTCGGCATGG ACGAGCTGTACAAGTAAGTCGACGGCGCGCCGCGGCCGCGAATTCGATATCATAATCAACCT CTGGATTACAAAATTTGTGAAAGATTGACTGGTATTCTTAACTATGTTGCTCCTTTTACGCTAT GTGGATACGCTGCTTTAATGCCTTTGTATCATGCTATTGCTTCCCGTATGGCTTTCATTTTCTC CTCCTTGTATAAATCCTGGTTAGTTCTTGCCACGGCGGAACTCATCGCCGCCTGCCTTGCCC GCTGCTGGACAGGGGCTCGGCTGTTGGGCACTGACAATTCCGTGGCTCGAGAGATCTTCGA CTGTGCCTTCTAGTTGCCAGCCATCTGTTGTTTGCCCCTCCCCCGTGCCTTCCTTGACCCTG GAAGGTGCCACTCCCACTGTCCTTTCCTAATAAAATGAGGAAATTGCATCGCATTGTCTGAGT AGGTGTCATTCTATTCTGGGGGGTGGGGTGGGGCAGGACAGCAAGGGGGAGGATTGGGAA GACAATAGCAGGCATGAGATCTCACGTGCGGACCGAGCGGCCGC (SEQ ID NO: 265) |
| CN2183 (1829) GCGGCCGCACGCGTAGCAGCAGCAGCAGGACACAGTCAAAGGGAAGATGTGAAAACATGGA GCTTGCAGAAGAAAGTCAGAGGACACCTCTGTTAGGCACAGTTTTAACTCTCCAAATGGACT GGGTACTTCTTCCAACTGTCTACTCCACAATCACATGAGCAGTAGCCGCCCCCACTGAGTGC TAGCTCAGCACACCCGGGTGTCTGATTGCCAGTGATTCTTATAGTAACACTGCCAGGTCTAC AGTCACATTAAAGGAAACCAAAGTTCTCTGTCATGCCACACTACACACATCCTGTAAGTGTTC TGATGTCTGTCCTGTGATATCAACAAAGAGGAAGCAATACTTCAGTGGAAGAAAACGCTACTC |

| Fig 26 cont'd |
| Vector ID (length between ITRs) & Sequence Between ITRs |
| AGTCATGGCACATAAAGAGAACCCTCTAATAATGTCTCAGATGAGATACACCTGAAATGGAGC ATGTCCGAGTCCATCTGACTAGCGGGGAACACAAAGTACAGATGCATCGAGCTCGGGCTGG GCATAAAAGTCAGGGCAGAGCCATCTATTGCTTACATTTGCTTCTGGGATCCAGATCTTTCGA AGCTAGCGCTACCGGTCGCCACCATGGTGAGCAAGGGCGAGGAGCTGTTCACCGGGGTGG TGCCCATCCTGGTCGAGCTGGACGGCGACGTAAACGGCCACAAGTTCAGCGTGTCCGGCGA GGGCGAGGGCGATGCCACCTACGGCAAGCTGACCCTGAAGCTGATCTGCACCACCGGCAA GCTGCCCGTGCCCTGGCCCACCCTCGTGACCACCCTGGGCTACGGCGTGCAGTGCTTCGC CCGCTACCCCGACCACATGAAGCAGCACGACTTCTTCAAGTCCGCCATGCCCGAAGGCTAC GTCCAGGAGCGCACCATCTTCTTCAAGGACGACGGCAACTACAAGACCCGCGCCGAGGTGA AGTTCGAGGGCGACACCCTGGTGAACCGCATCGAGCTGAAGGGCATCGACTTCAAGGAGGA CGGCAACATCCTGGGGCACAAGCTGGAGTACAACTACAACAGCCACAACGTCTATATCACCG CCGACAAGCAGAAGAACGGCATCAAGGCCAACTTCAAGATCCGCCACAACATCGAGGACGG CGGCGTGCAGCTCGCCGACCACTACCAGCAGAACACCCCCATCGGCGACGGCCCCGTGCT GCTGCCCGACAACCACTACCTGAGCTACCAGTCCAAGCTGAGCAAAGACCCCAACGAGAAG CGCGATCACATGGTCCTGCTGGAGTTCGTGACCGCCGCCGGGATCACTCTCGGCATGGACG AGCTGTACAAGTAAGTCGACGGCGCGCCGCGGCCGCGAATTCGATATCATAATCAACCTCTG GATTACAAAATTTGTGAAAGATTGACTGGTATTCTTAACTATGTTGCTCCTTTTACGCTATGTG GATACGCTGCTTTAATGCCTTTGTATCATGCTATTGCTTCCCGTATGGCTTTCATTTTCTCCTC CTTGTATAAATCCTGGTTAGTTCTTGCCACGGCGGAACTCATCGCCGCCTGCCTTGCCCGCT GCTGGACAGGGGCTCGGCTGTTGGGCACTGACAATTCCGTGGCTCGAGAGATCTTCGACTG TGCCTTCTAGTTGCCAGCCATCTGTTGTTTGCCCCTCCCCCGTGCCTTCCTTGACCCTGGAA GGTGCCACTCCCACTGTCCTTTCCTAATAAAATGAGGAAATTGCATCGCATTGTCTGAGTAGG TGTCATTCTATTCTGGGGGGTGGGGTGGGGCAGGACAGCAAGGGGGAGGATTGGGAAGAC AATAGCAGGCATGAGATCTCACGTGCGGACCGAGCGGCCGC (SEQ ID NO: 266) |
| CN2184 (1655) GCGGCCGCACGCGTCACGGTGGGAGGAAGGAACATGTTACATTTCTTCAAAGATAACTGCA GATCGAATGCCTTCATCCTTGTGACCCGCGCTGCCTGCACTGTGGTGTGTTTTGCTTGGTTT GCACCAATGCCCTGGCTGGCGGTCACTTGCTCTTGGTGGCCAGTTTCATTTCCTGGTTTTGA GAAAATGTCAGGGAGGCCTGTTGCTTGGGCATACTGTCACTGAGGGAAGTGTGCAGTTTTAA AATGTCAAAGCCAGCAGGCTCATGTCCAGTGCATGCCATCAATCAGCAAATGTCCCTGGACC CCGAGCTCGGGCTGGGCATAAAAGTCAGGGCAGAGCCATCTATTGCTTACATTTGCTTCTGG GATCCAGATCTTTCGAAGCTAGCGCTACCGGTCGCCACCATGGTGAGCAAGGGCGAGGAGC TGTTCACCGGGGTGGTGCCCATCCTGGTCGAGCTGGACGGCGACGTAAACGGCCACAAGTT CAGCGTGTCCGGCGAGGGCGAGGGCGATGCCACCTACGGCAAGCTGACCCTGAAGCTGAT CTGCACCACCGGCAAGCTGCCCGTGCCCTGGCCCACCCTCGTGACCACCCTGGGCTACGG CGTGCAGTGCTTCGCCCGCTACCCCGACCACATGAAGCAGCACGACTTCTTCAAGTCCGCC ATGCCCGAAGGCTACGTCCAGGAGCGCACCATCTTCTTCAAGGACGACGGCAACTACAAGA CCCGCGCCGAGGTGAAGTTCGAGGGCGACACCCTGGTGAACCGCATCGAGCTGAAGGGCA TCGACTTCAAGGAGGACGGCAACATCCTGGGGCACAAGCTGGAGTACAACTACAACAGCCA CAACGTCTATATCACCGCCGACAAGCAGAAGAACGGCATCAAGGCCAACTTCAAGATCCGCC ACAACATCGAGGACGGCGGCGTGCAGCTCGCCGACCACTACCAGCAGAACACCCCCATCGG CGACGGCCCCGTGCTGCTGCCCGACAACCACTACCTGAGCTACCAGTCCAAGCTGAGCAAA GACCCCAACGAGAAGCGCGATCACATGGTCCTGCTGGAGTTCGTGACCGCCGCCGGGATCA CTCTCGGCATGGACGAGCTGTACAAGTAAGTCGACGGCGCGCCGCGGCCGCGAATTCGATA TCATAATCAACCTCTGGATTACAAAATTTGTGAAAGATTGACTGGTATTCTTAACTATGTTGCT CCTTTTACGCTATGTGGATACGCTGCTTTAATGCCTTTGTATCATGCTATTGCTTCCCGTATGG CTTTCATTTTCTCCTCCTTGTATAAATCCTGGTTAGTTCTTGCCACGGCGGAACTCATCGCCG CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCCGTGCCTT |

| Fig 26 cont'd |
|---|
| Vector ID (length between ITRs) & Sequence Between ITRs |
| CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCG (SEQ ID NO: 267) |
| CN1781 (2478) GCGGCCGCAACGCGTTTAGAACAATGGCTGGCCCATAGTAAATGCCGTGTTAGTGTGTTAGT TGCTGTTCTTCCACGTCAGAAGAGGCACAGACAAATTACCACCAGGTGGCGCTCAGAGTCTG CGGAGGCATCACAACAGCCCTGAATTTGAATCCTGCTCTGCCACTGCCTAGTTGAGACCTTT TACTACCTGACTAGCTGTTTGTGTATTTTAGGTGTTTGTTTGCGACACAGCCAGACCCTGTCT CGAGAAAAAGTAAAAAAGAAAAAAAACAGGAAGCATAAAGCTCCACTGTGCCGAAGTTGT GCAGGGTACACGTCTCTCTGTTCCCAGCCCCGAGGCCTGGATAGTATGAGAGGATCCAGCC ACCCTACCCCAGTGCAGCCCTAGCCCCAGCAGAGCCACCACCCAGACCTGCAGCCCCGGG CTGGACTGGGGGTGGGGCAGCCCTGAGCTGGGCCCATGCTGTTCACAGGAACCAGCTGTCT GCTGTTCGACTGGAGTCCTGTCTCTCACAGAGTCCCCGGTCAAGCCTGGGTGCCCTCTACTG CCCGTGAGCCACACAGCAGGTCCGGGGGCTTCCTGCCGCCCCTCCTGAGCATGCAACCCCA CAGGCGTGCCCGCCTGGGCAGCTGCTTCAGGGTCTGGGGGCAGCCCGAGGCGACGCCCAA GCAATAGCGGCCCAGCGCCTTCCAGAAGTCTCCAGACACTGAGGCCTCTCCTTGCAGGCCT GGTCGCAGCTTTATTGCCCCCACTCTATGGATGACTGCATGGGTGAGCCCACGGCCATGCA GGGAGCCCGGTCCTCCGGGCTGGGACCGGCCTTGAGATGGGATGCATGGCCAGGAGGCG GGCGATGGCCGAGGTGAGGGGCTCAGGGAGGGGGCTGGTCATGGCATTCAGAGCCAGGTT ATGATGGGGCCTGGCCATTGACGACAGACGGGGTGATGACAGCGGGGCCCCAGGATGGAG CCTGCAGTCCACGACATTCAGAGCAGAGCATGGGGCATGCAGGAAAGGGGGCCAGAGGAC CTGCTGGGTCTTTCCGGGTGTATGGTGCCGAATTCGATATCATAATCAACCATAGGTACCGA GCTCGGGATTCAGCCGGGAGCTTAGGGAGGGGAGGTCACTTCATAAGGGCCTGGGGGGGG AGTTGGAGCCACGAGTCGTCCAGCCGGAGCCCCGTGTGGCTGAGCTCCGGCCTCAGAAGC ATCCCCGGGTTGGATCCTTCGAAGCTAGCGCTACCGGTCGCCACCATGGTGAGCAAGGGCG AGGAGCTGTTCACCGGGGTGGTGCCCATCCTGGTCGAGCTGGACGGCGACGTAAACGGCC ACAAGTTCAGCGTGTCCGGCGAGGGCGAGGGCGATGCCACCTACGGCAAGCTGACCCTGA AGCTGATCTGCACCACCGGCAAGCTGCCCGTGCCCTGGCCCACCCTCGTGACCACCCTGGG CTACGGCGTGCAGTGCTTCGCCCGCTACCCCGACCACATGAAGCAGCACGACTTCTTCAAGT CCGCCATGCCCGAAGGCTACGTCCAGGAGCGCACCATCTTCTTCAAGGACGACGGCAACTA CAAGACCCGCGCCGAGGTGAAGTTCGAGGGCGACACCCTGGTGAACCGCATCGAGCTGAA GGGCATCGACTTCAAGGAGGACGGCAACATCCTGGGGCACAAGCTGGAGTACAACTACAAC AGCCACAACGTCTATATCACCGCCGACAAGCAGAAGAACGGCATCAAGGCCAACTTCAAGAT CCGCCACAACATCGAGGACGGCGGCGTGCAGCTCGCCGACCACTACCAGCAGAACACCCC CATCGGCGACGGCCCCGTGCTGCTGCCCGACAACCACTACCTGAGCTACCAGTCCAAGCTG AGCAAAGACCCCAACGAGAAGCGCGATCACATGGTCCTGCTGGAGTTCGTGACCGCCGCCG GGATCACTCTCGGCATGGACGAGCTGTACAAGTAAGTCGACATCATAATCAACCTCTGGATT ACAAAATTTGTGAAAGATTGACTGGTATTCTTAACTATGTTGCTCCTTTTACGCTATGTGGATA CGCTGCTTTAATGCCTTTGTATCATGCTATTGCTTCCCGTATGGCTTTCATTTTCTCCTCCTTG TATAAATCCTGGTTAGTTCTTGCCACGGCGGAACTCATCGCCGCCTGCCTTGCCCGCTGCTG GACAGGGGCTCGGCTGTTGGGCACTGACAATTCCGTGGCTCGAGAGATCTTCGACTGTGCC TTCTAGTTGCCAGCCATCTGTTGTTTGCCCCTCCCCCGTGCCTTCCTTGACCCTGGAAGGTG CCACTCCCACTGTCCTTTCCTAATAAAATGAGGAAATTGCATCGCATTGTCTGAGTAGGTGTC ATTCTATTCTGGGGGGTGGGGTGGGGCAGGACAGCAAGGGGGAGGATTGGGAAGACAATA GCAGGCATGCACGTGCGGACCGAGCGGCCGC (SEQ ID NO: 268) |
| CN1782 (2043) GCGGCCGCAACGCGTTTAGAACAATGGCTGGCCCATAGTAAATGCCGTGTTAGTGTGTTAGT TGCTGTTCTTCCACGTCAGAAGAGGCACAGACAAATTACCACCAGGTGGCGCTCAGAGTCTG |

| Fig 26 cont'd |
| --- |
| Vector ID (length between ITRs) & Sequence Between ITRs |
| CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTTTGTGTGCATATGGGAGATCCAA<br>AGATGAAAACAAACGTAGTCGTAGAATTATAGATTATTTCAGCCAAAAGGTCCAAATAAATTAC<br>CTAACCTCAACTTTTCTTTTTACAGTGAGGAATCTGAGGCCCAGAGAGATTAAGAAGCTTCAC<br>AAGTGACATGACTTGTGCCAAATCACAAGGTCATTTAGTTGCAGAACTGGGACAGGAATTCAT<br>GCCCAGTTCTCTTTTCAAAACCCTGTGGAAAAAAGAAGCACATTGAATTTAGCCTTTGATTCG<br>TCATCAGCATTATCAGAGGTAAAGCAAAAGGGAGTATTAACAGATGTTCAGCAAAATGGAGGA<br>GGTAAATTCAGAGCAGATGTTTTGACAATGAAGTAAAGAAGGAGAACTGAGGACACTGAGAG<br>CCTGAATTCGATATCATAATCAACCATAGGTACCGAGCTCGGGATTCAGCCGGGAGCTTAGG<br>GAGGGGAGGTCACTTCATAAGGGCCTGGGGGGGGGAGTTGGAGCCACGAGTCGTCCAGCCG<br>GAGCCCCGTGTGGCTGAGCTCCGGCCTCAGAAGCATCCCCGGGTTGGATCCTTCGAAGCTA<br>GCGCTACCGGTCGCCACCATGGTGAGCAAGGGCGAGGAGCTGTTCACCGGGGTGGTGCCC<br>ATCCTGGTCGAGCTGGACGGCGACGTAAACGGCCACAAGTTCAGCGTGTCCGGCGAGGGC<br>GAGGGCGATGCCACCTACGGCAAGCTGACCCTGAAGCTGATCTGCACCACCGGCAAGCTGC<br>CCGTGCCCTGGCCCACCCTCGTGACCACCCTGGGCTACGGCGTGCAGTGCTTCGCCCGCTA<br>CCCCGACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGACGGCAA<br>CATCCTGGGGCACAAGCTGGAGTACAACTACAACAGCCACAACGTCTATATCACCGCCGACA<br>AGCAGAAGAACGGCATCAAGGCCAACTTCAAGATCCGCCACAACATCGAGGACGGCGGCGT<br>GCAGCTCGCCGACCACTACCAGCAGAACACCCCCATCGGCGACGGCCCCGTGCTGCTGCC<br>CGACAACCACTACCTGAGCTACCAGTCCAAGCTGAGCAAAGACCCCAACGAGAAGCGCGAT<br>CACATGGTCCTGCTGGAGTTCGTGACCGCCGCCGGGATCACTCTCGGCATGGACGAGCTGT<br>ACAAGTAAGTCGACATCATAATCAACCTCTGGATTACAAAATTTGTGAAAGATTGACTGGTATT<br>CTTAACTATGTTGCTCCTTTTACGCTATGTGGATACGCTGCTTTAATGCCTTTGTATCATGCTA<br>TTGCTTCCCGTATGGCTTTCATTTTCTCCTCCTTGTATAAATCCTGGTTAGTTCTTGCCACGGC<br>GGAACTCATCGCCGCCTGCCTTGCCCGCTGCTGGACAGGGGCTCGGCTGTTGGGCACTGAC<br>AATTCCGTGGCTCGAGAGATCTTCGACTGTGCCTTCTAGTTGCCAGCCATCTGTTGTTTGCCC<br>CTCCCCCGTGCCTTCCTTGACCCTGGAAGGTGCCACTCCCACTGTCCTTTCCTAATAAAATGA<br>GGAAATTGCATCGCATTGTCTGAGTAGGTGTCATTCTATTCTGGGGGGTGGGGTGGGGCAG<br>GACAGCAAGGGGGAGGATTGGGAAGACAATAGCAGGCATGCACGTGCGGACCGAGCGGCC<br>GC (SEQ ID NO: 269) |
| CN1783 (2080)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTGTAGGAAACAGGAGACAGCTGA<br>CCAGTGATATACAACATTGCCAAATGGCACTGACAATCCTAAGATATTTAAATTTGCAGTTTAA<br>TCAATCTGCTCATTGTATAATTGTAGCCTGCAGTGTTCAGTATCTGAGGCAACAGATAGGACT<br>ACTTCAAGGTTGGAAGACTGAAGAAGGGAAAAATAAAAGGTCAGTTTAGAATGGGACTGTTCT<br>CCAGTTAGTCTCCTTACAATATTCAGGGAAATGTAACATTTTCTTGGCCCAATTATATGCTTGT<br>TTGTTTGGAGACAGGGTCTTGCCTTGTTGCCCAGGCTGCCATACAAGTGGCACAGGACAGCT<br>CACTGCAGCCTTGAACTCCTGGGCTCCAGTAATTCTCCCACTTCAGCCTCCCCAGTAGCTGG<br>GACTACAGGCGTGCACTACCATACCCAGCTAATTTTTAAACGAATTCGATATCATAATCAACC<br>ATAGGTACCGAGCTCGGGATTCAGCCGGGAGCTTAGGGAGGGGAGGTCACTTCATAAGGGC<br>CTGGGGGGGGAGTTGGAGCCACGAGTCGTCCAGCCGGAGCCCCGTGTGGCTGAGCTCCGG<br>CCTCAGAAGCATCCCCGGGTTGGATCCTTCGAAGCTAGCGCTACCGGTCGCCACCATGGTG<br>AGCAAGGGCGAGGAGCTGTTCACCGGGGTGGTGCCCATCCTGGTCGAGCTGGACGGCGAC<br>GTAAACGGCCACAAGTTCAGCGTGTCCGGCGAGGGCGAGGGCGATGCCACCTACGGCAAG |

| Fig 26 cont'd |
| --- |
| Vector ID (length between ITRs) & Sequence Between ITRs |
| CTGACCCTGAAGCTGATCTGCACCACCGGCAAGCTGCCCGTGCCCTGGCCCACCCTCGTGA<br>CCACCCTGGGCTACGGCGTGCAGTGCTTCGCCCGCTACCCCGACCACATGAAGCAGCACGA<br>CTTCTTCAAGTCCGCCATGCCCGAAGGCTACGTCCAGGAGCGCACCATCTTCTTCAAGGACG<br>ACGGCAACTACAAGACCCGCGCCGAGGTGAAGTTCGAGGGCGACACCCTGGTGAACCGCAT<br>CGAGCTGAAGGGCATCGACTTCAAGGAGGACGGCAACATCCTGGGGCACAAGCTGGAGTAC<br>AACTACAACAGCCACAACGTCTATATCACCGCCGACAAGCAGAAGAACGGCATCAAGGCCAA<br>CTTCAAGATCCGCCACAACATCGAGGACGGCGGCGTGCAGCTCGCCGACCACTACCAGCAG<br>AACACCCCCATCGGCGACGGCCCCGTGCTGCTGCCCGACAACCACTACCTGAGCTACCAGT<br>CCAAGCTGAGCAAAGACCCCAACGAGAAGCGCGATCACATGGTCCTGCTGGAGTTCGTGAC<br>CGCCGCCGGGATCACTCTCGGCATGGACGAGCTGTACAAGTAAGTCGACATCATAATCAACC<br>TCTGGATTACAAAATTTGTGAAAGATTGACTGGTATTCTTAACTATGTTGCTCCTTTTACGCTA<br>TGTGGATACGCTGCTTTAATGCCTTTGTATCATGCTATTGCTTCCCGTATGGCTTTCATTTTCT<br>CCTCCTTGTATAAATCCTGGTTAGTTCTTGCCACGGCGGAACTCATCGCCGCCTGCCTTGCC<br>CGCTGCTGGACAGGGGCTCGGCTGTTGGGCACTGACAATTCCGTGGCTCGAGAGATCTTCG<br>ACTGTGCCTTCTAGTTGCCAGCCATCTGTTGTTTGCCCCTCCCCCGTGCCTTCCTTGACCCT<br>GGAAGGTGCCACTCCCACTGTCCTTTCCTAATAAAATGAGGAAATTGCATCGCATTGTCTGAG<br>TAGGTGTCATTCTATTCTGGGGGGTGGGGTGGGGCAGGACAGCAAGGGGGAGGATTGGGA<br>AGACAATAGCAGGCATGCACGTGCGGACCGAGCGGCCGC (SEQ ID NO: 270) |
| CN1784 (2180)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTCTGCTTGGCTGAGTTTTCCAGAT<br>ATCAAAGCCCAGCTGCAGCCTGTGACTTTCACACTCCTGGAAAAGTAGACGTATCTGCCTGC<br>TCTTACAGCAGGCTTTAGCTTGCCTTTGCTGGGACTTTGTTCTGCCCTCAGTTACCACAGTAA<br>TTAGGTTGCCTCTTCTACTTTCCTCTTTTCTCACAGGCACCAGGAGCCAGAGGAAATAACATA<br>ATAGTTGTTGACCAGAGCAGCAGCATAATTCTTTCATGACTGCCTTTTCTAATTTGACGATTCC<br>CTCTCCTGAGAGGGCTCTTTGTGTCCTCCTCCTCTTCGTCTCCAACTTTTAAAAAAAAAAAAGT<br>GAAACTATCAAGTATTGCTCCTGCTAACTTCAGATCAGTATTTTCTTTCTCTGAAGCCAATGCA<br>AAGTAATAACGGACGTGCTTCATCATCTTAGCATTCAGCACACGTGTCACCATCTCTGATGGT<br>GTGAGCATGTTAAACCAGACTTGTGGGTACTTACCAAAAGGTTCAGTTGACACTATAGGTCAG<br>TTGCTAAAAGGCGAATTCGATATCATAATCAACCATAGGTACCGAGCTCGGGATTCAGCCGG<br>GAGCTTAGGGAGGGGAGGTCACTTCATAAGGGCCTGGGGGGGGAGTTGGAGCCACGAGTC<br>GTCCAGCCGGAGCCCCGTGTGGCTGAGCTCCGGCCTCAGAAGCATCCCCGGGTTGGATCCT<br>TCGAAGCTAGCGCTACCGGTCGCCACCATGGTGAGCAAGGGCGAGGAGCTGTTCACCGGG<br>GTGGTGCCCATCCTGGTCGAGCTGGACGGCGACGTAAACGGCCACAAGTTCAGCGTGTCCG<br>GCGAGGGCGAGGGCGATGCCACCTACGGCAAGCTGACCCTGAAGCTGATCTGCACCACCG<br>GCAAGCTGCCCGTGCCCTGGCCCACCCTCGTGACCACCCTGGGCTACGGCGTGCAGTGCTT<br>CGCCCGCTACCCCGACCACATGAAGCAGCACGACTTCTTCAAGTCCGCCATGCCCGAAGGC<br>TACGTCCAGGAGCGCACCATCTTCTTCAAGGACGACGGCAACTACAAGACCCGCGCCGAGG<br>TGAAGTTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCTATATCA<br>CCGCCGACAAGCAGAAGAACGGCATCAAGGCCAACTTCAAGATCCGCCACAACATCGAGGA<br>CGGCGGCGTGCAGCTCGCCGACCACTACCAGCAGAACACCCCCATCGGCGACGGCCCCGT<br>GCTGCTGCCCGACAACCACTACCTGAGCTACCAGTCCAAGCTGAGCAAAGACCCCAACGAG<br>AAGCGCGATCACATGGTCCTGCTGGAGTTCGTGACCGCCGCCGGGATCACTCTCGGCATGG<br>ACGAGCTGTACAAGTAAGTCGACATCATAATCAACCTCTGGATTACAAAATTTGTGAAAGATT<br>GACTGGTATTCTTAACTATGTTGCTCCTTTTACGCTATGTGGATACGCTGCTTTAATGCCTTTG<br>TATCATGCTATTGCTTCCCGTATGGCTTTCATTTTCTCCTCCTTGTATAAATCCTGGTTAGTTC |

| Fig 26 cont'd |
|---|
| Vector ID (length between ITRs) & Sequence Between ITRs |
| TTGCCACGGCGGAACTCATCGCCGCCTGCCTTGCCCGCTGCTGGACAGGGGCTCGGCTGTT<br>GGGCACTGACAATTCCGTGGCTCGAGAGATCTTCGACTGTGCCTTCTAGTTGCCAGCCATCT<br>GTTGTTTGCCCCTCCCCCGTGCCTTCCTTGACCCTGGAAGGTGCCACTCCCACTGTCCTTTC<br>CTAATAAAATGAGGAAATTGCATCGCATTGTCTGAGTAGGTGTCATTCTATTCTGGGGGGTGG<br>GGTGGGGCAGGACAGCAAGGGGGAGGATTGGGAAGACAATAGCAGGCATGCACGTGCGGA<br>CCGAGCGGCCGC (SEQ ID NO: 271) |
| CN1785 (2161)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTGGAAGCTGGCTGGTGGTCAGAG<br>CTGCTGTTTCATTAACAGGGGCCCAAAGGCCAGGGCTCTCTGGAGAAGGTCCCTGGGTCTT<br>GAGGATGTACAAGGAATCTTCTAGACCACAGGCCCCACCTTTGGGGAGGAGGGGGTCTGCA<br>GAGCTGGGTGTTGCCCTGGCTCAGTGCCTGGCAGAATAGAAGCCACAGAGGCAGCTGGGC<br>CCTGTCCTGCCCCAGGAGAAATCTCCCAGGGTGACCCACAGCCCTGCCCACCCCTCTGTGA<br>GGCAGGCAGGAAGTGAAAGAGGAAGGATCCCTGCGAAAGGACCCAAACTGTTTTCTGCCAT<br>GGGGAGGTCGGGGGGGGGATGCCACGTCTGGCATCTGTGGGCGGAGGCTGAGCAGGACT<br>CCTCTGCAGGGGTGTGTGGGGCAGGCAGGATGGATGGCAGTGGGCACTTCTCCCACTAGAA<br>GTGGATCCCATAGATGACACTTCAAGAGCCCTGTGAACCCAACATGGGCCACAGCTGGAGC<br>GGTGGGTGGGCTAGAGAATTCGATATCATAATCAACCATAGGTACCGAGCTCGGGATTCAGC<br>CGGGAGCTTAGGGAGGGGAGGTCACTTCATAAGGGCCTGGGGGGGGGAGTTGGAGCCACGA<br>GTCGTCCAGCCGGAGCCCCGTGTGGCTGAGCTCCGGCCTCAGAAGCATCCCCGGGTTGGA<br>TCCTTCGAAGCTAGCGCTACCGGTCGCCACCATGGTGAGCAAGGGCGAGGAGCTGTTCACC<br>GGGGTGGTGCCCATCCTGGTCGAGCTGGACGGCGACGTAAACGGCCACAAGTTCAGCGTGT<br>CCGGCGAGGGCGAGGGCGATGCCACCTACGGCAAGCTGACCCTGAAGCTGATCTGCACCA<br>CCGGCAAGCTGCCCGTGCCCTGGCCCACCCTCGTGACCACCCTGGGCTACGGCGTGCAGT<br>GCTTCGCCCGCTACCCCGACCACATGAAGCAGCACGACTTCTTCAAGTCCGCCATGCCCGA<br>AGGCTACGTCCAGGAGCGCACCATCTTCTTCAAGGACGACGGCAACTACAAGACCCGCGCC<br>GAGGTGAAGTTCGAGGGCGACACCCTGGTGAACCGCATCGAGCTGAAGGGCATCGACTTCA<br>AGGAGGACGGCAACATCCTGGGGCACAAGCTGGAGTACAACTACAACAGCCACAACGTCTA<br>TATCACCGCCGACAAGCAGAAGAACGGCATCAAGGCCAACTTCAAGATCCGCCACAACATCG<br>AGGACGGCGGCGTGCAGCTCGCCGACCACTACCAGCAGAACACCCCCATCGGCGACGGCC<br>CCGTGCTGCTGCCCGACAACCACTACCTGAGCTACCAGTCCAAGCTGAGCAAAGACCCCAA<br>CGAGAAGCGCGATCACATGGTCCTGCTGGAGTTCGTGACCGCCGCCGGGATCACTCTCGGC<br>ATGGACGAGCTGTACAAGTAAGTCGACATCATAATCAACCTCTGGATTACAAAATTTGTGAAA<br>GATTGACTGGTATTCTTAACTATGTTGCTCCTTTTACGCTATGTGGATACGCTGCTTTAATGCC<br>TTTGTATCATGCTATTGCTTCCCGTATGGCTTTCATTTTCTCCTCCTTGTATAAATCCTGGTTA<br>GTTCTTGCCACGGCGGAACTCATCGCCGCCTGCCTTGCCCGCTGCTGGACAGGGGCTCGGC<br>TGTTGGGCACTGACAATTCCGTGGCTCGAGAGATCTTCGACTGTGCCTTCTAGTTGCCAGCC<br>ATCTGTTGTTTGCCCCTCCCCCGTGCCTTCCTTGACCCTGGAAGGTGCCACTCCCACTGTCC<br>TTTCCTAATAAAATGAGGAAATTGCATCGCATTGTCTGAGTAGGTGTCATTCTATTCTGGGGG<br>GTGGGGTGGGGCAGGACAGCAAGGGGGAGGATTGGGAAGACAATAGCAGGCATGCACGTG<br>CGGACCGAGCGGCCGC (SEQ ID NO: 272) |
| CN1786 (2285)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTTGTCAGTAGTCCAAAAGTGATTT<br>CAAGATTTAATTATTCATCACGTGATTAAAAATAAAATTAATATTAACATGCAAATGTGTAGTTT |

| Fig 26 cont'd |
| --- |
| Vector ID (length between ITRs) & Sequence Between ITRs |
| TCTTAACAATATTGGCCAATATTATTTTAAAGAACATCTCTGAATGTTTTCACGTAAGAAAAGA<br>GACTGTCCCAGAAATCCTGGACCCAGTTATCCTGAAGTTTCCTCTGATTCATCAAGTATTTAA<br>GTTTCCAGGCCAACAGAAGCCTGAGGCTCAAATATTTGTAGCAAATCGGTGACTCAGGGCAA<br>CACAGCAGAACCCTGAGAAACAATGAAGAAGGAATTGTTTATAATCTTGTGCTCAGTTACACA<br>AAAGATACACATTTATTTTCACCACCACCCACCAAAGACCCCAGAGGATCCAGAGGCTATAAT<br>AATAGAATATGTTACCAAAGGAAATACAAGATGACCCATTAAATTTGAATTTCAGATACTCAAA<br>CAAAAAAATTTAAAGTATGCTACAGGCACTATTTGGAGTATACTTATACTAAAAAAAAATGTTGT<br>TTATCTGAAATTCAAATTTAAATGGGCAATTTTTATTTTTGTTTTTGTTTTGTTATTTTGATAAAT<br>CTAGGAACATCTTTACCTCCACATACAATTCAAGGCTGATCAGTGAGGGGAATTCGATATCAT<br>AATCAACCATAGGTACCGAGCTCGGGATTCAGCCGGGAGCTTAGGGAGGGGAGGTCACTTC<br>ATAAGGGCCTGGGGGGGGAGTTGGAGCCACGAGTCGTCCAGCCGGAGCCCCGTGTGGCTG<br>AGCTCCGGCCTCAGAAGCATCCCCGGGTTGGATCCTTCGAAGCTAGCGCTACCGGTCGCCA<br>CCATGGTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGCCACCT<br>ACGGCAAGCTGACCCTGAAGCTGATCTGCACCACCGGCAAGCTGCCCGTGCCCTGGCCCAC<br>CCTCGTGACCACCCTGGGCTACGGCGTGCAGTGCTTCGCCCGCTACCCCGACCACATGAAG<br>CAGCACGACTTCTTCAAGTCCGCCATGCCCGAAGGCTACGTCCAGGAGCGCACCATCTTCTT<br>CAAGGACGACGGCAACTACAAGACCCGCGCCGAGGTGAAGTTCGAGGGCGACACCCTGGT<br>GAACCGCATCGAGCTGAAGGGCATCGACTTCAAGGAGGACGGCAACATCCTGGGGCACAAG<br>CTGGAGTACAACTACAACAGCCACAACGTCTATATCACCGCCGACAAGCAGAAGAACGGCAT<br>CAAGGCCAACTTCAAGATCCGCCACAACATCGAGGACGGCGGCGTGCAGCTCGCCGACCAC<br>TACCAGCAGAACACCCCCATCGGCGACGGCCCCGTGCTGCTGCCCGACAACCACTACCTGA<br>GCTACCAGTCCAAGCTGAGCAAAGACCCCAACGAGAAGCGCGATCACATGGTCCTGCTGGA<br>GTTCGTGACCGCCGCCGGGATCACTCTCGGCATGGACGAGCTGTACAAGTAAGTCGACATC<br>ATAATCAACCTCTGGATTACAAAATTTGTGAAAGATTGACTGGTATTCTTAACTATGTTGCTCC<br>TTTTACGCTATGTGGATACGCTGCTTTAATGCCTTTGTATCATGCTATTGCTTCCCGTATGGCT<br>TTCATTTTCTCCTCCTTGTATAAATCCTGGTTAGTTCTTGCCACGGCGGAACTCATCGCCGCC<br>TGCCTTGCCCGCTGCTGGACAGGGGCTCGGCTGTTGGGCACTGACAATTCCGTGGCTCGAG<br>AGATCTTCGACTGTGCCTTCTAGTTGCCAGCCATCTGTTGTTTGCCCCTCCCCCGTGCCTTCC<br>TTGACCCTGGAAGGTGCCACTCCCACTGTCCTTTCCTAATAAAATGAGGAAATTGCATCGCAT<br>TGTCTGAGTAGGTGTCATTCTATTCTGGGGGGTGGGGTGGGGCAGGACAGCAAGGGGGAG<br>GATTGGGAAGACAATAGCAGGCATGCACGTGCGGACCGAGCGGCCGC (SEQ ID NO: 273) |
| CN1787 (2416)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTGCACTTAAAAGAATGTCTGGAAC<br>ATAGTGTTATCAGCGTTTATAAAATAAACGAATATACTACAGCAAAGATGATGAATGTTTAAAT<br>TTATATCTAGAAACAGAGATTGAGAGCAGAGACAAATCCACAAGACGTAAGAAGAAAAAAGTG<br>ATGGGCTTGATGATTGAGGAAGAAAAAGGACTGGAATGAAGTCTTGGGATTCCAATGGTCAC<br>TGGAAGGGGTCGGCAAGCTTCTTCCATTAATTCATTGCCTTTAATTATTTGATCATAGGAAAG<br>GAGAGTCTGGCCTTGTGGAAAAACACACAATCAGTTTCATTAGAAAAGAGAGAGTCAGATGTT<br>TTTAAAACAGCAACAACAATATGCCCTGAATAGTAGAGAAACAAAGAGCGATTGATCTACAA<br>AGGCAAGACCCAGATTGAGACCACAGTGAACCCTGCAAAACAGAGGAGCCCCTGGGTGGGA<br>GGGGATATAACTGGAACTCTGGGAATGTAACGGGCATGGTGTGCTTGTCTGATGGACAGGG<br>CAGCTTAGGGGAATAAGTCTCTGCAGCGTTGTAGTGAAGAGAGAATACGGGACAACTGCAG<br>GACCACAGCTCAGCCAAGAGTAAGCATAAATTTAAACATATTTCTTGATTTCTCTAAAGTCTCT<br>CTTTTCTGTTAAATACAAATAATAATGCATGCTTCATTCAGCAAGTTATTGTGAGGACTAAATG<br>AGACAGTATTGAAGTTACTATGTAACAGTAAATAAGGTACAGATAATCCTCAGTACAAGCACG |

| Fig 26 cont'd |
| --- |
| Vector ID (length between ITRs) & Sequence Between ITRs |
| ATGAATTCGATATCATAATCAACCATAGGTACCGAGCTCGGGATTCAGCCGGGAGCTTAGGG<br>AGGGGAGGTCACTTCATAAGGGCCTGGGGGGGGGAGTTGGAGCCACGAGTCGTCCAGCCGG<br>AGCCCCGTGTGGCTGAGCTCCGGCCTCAGAAGCATCCCCGGGTTGGATCCTTCGAAGCTAG<br>CGCTACCGGTCGCCACCATGGTGAGCAAGGGCGAGGAGCTGTTCACCGGGGTGGTGCCCA<br>TCCTGGTCGAGCTGGACGGCGACGTAAACGGCCACAAGTTCAGCGTGTCCGGCGAGGGCG<br>AGGGCGATGCCACCTACGGCAAGCTGACCCTGAAGCTGATCTGCACCACCGGCAAGCTGCC<br>CGTGCCCTGGCCCACCCTCGTGACCACCCTGGGCTACGGCGTGCAGTGCTTCGCCCGCTAC<br>CCCGACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAGTTCGA<br>GGGCGACACCCTGGTGAACCGCATCGAGCTGAAGGGCATCGACTTCAAGGAGGACGGCAA<br>CATCCTGGGGCACAAGCTGGAGTACAACTACAACAGCCACAACGTCTATATCACCGCCGACA<br>AGCAGAAGAACGGCATCAAGGCCAACTTCAAGATCCGCCACAACATCGAGGACGGCGGCGT<br>GCAGCTCGCCGACCACTACCAGCAGAACACCCCCATCGGCGACGGCCCCGTGCTGCTGCC<br>CGACAACCACTACCTGAGCTACCAGTCCAAGCTGAGCAAAGACCCCAACGAGAAGCGCGAT<br>CACATGGTCCTGCTGGAGTTCGTGACCGCCGCCGGGATCACTCTCGGCATGGACGAGCTGT<br>ACAAGTAAGTCGACATCATAATCAACCTCTGGATTACAAAATTTGTGAAAGATTGACTGGTATT<br>CTTAACTATGTTGCTCCTTTTACGCTATGTGGATACGCTGCTTTAATGCCTTTGTATCATGCTA<br>TTGCTTCCCGTATGGCTTTCATTTTCTCCTCCTTGTATAAATCCTGGTTAGTTCTTGCCACGGC<br>GGAACTCATCGCCGCCTGCCTTGCCCGCTGCTGGACAGGGGCTCGGCTGTTGGGCACTGAC<br>AATTCCGTGGCTCGAGAGATCTTCGACTGTGCCTTCTAGTTGCCAGCCATCTGTTGTTTGCCC<br>CTCCCCCGTGCCTTCCTTGACCCTGGAAGGTGCCACTCCCACTGTCCTTTCCTAATAAAATGA<br>GGAAATTGCATCGCATTGTCTGAGTAGGTGTCATTCTATTCTGGGGGGTGGGGTGGGGCAG<br>GACAGCAAGGGGGAGGATTGGGAAGACAATAGCAGGCATGCACGTGCGGACCGAGCGGCC<br>GC (SEQ ID NO: 274) |
| CN1788 (2331)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTTCCAGTGTTAAGGATGAGCTAAA<br>AATCTTGTAGGGAATTTGCTTGAAAATAAATTTTACCCCCTTTCAGAGACTTAGTGTCCTAAAT<br>GAGCTGATGGGGAACCTGGCCTTGTGATCCTTTTTTCCACTGAAGCAAAAAAGAAGATTGTAT<br>AAAAAAGAAATGGCTGCAGGATCCAGGATTTTGCCTTTCTTTGTTTCCTGGAAGACTTCAATA<br>TATCCGCTAATTAGAGGTTGCAGTGAGCAGATATTGCACCACTGCACTCCAGCCTGGGCAAC<br>AGAATGAGACCCTGTCTCAGAAAAAAAAAGACATCCACTAATTAATGCAAAGTTAGTAATTAAC<br>TGGCTCCCTTTCCCTAGAACATGGTCCAGGTACTGTGTTCACTTAAAGACTATCAGAGTTACC<br>AAAACTGTTAGCTGGAATGATACAGGCATGGTTAAAATCCTTTGGTTACATTTATACTGTTTCT<br>AGGGAACCTGGCATAGTGCTGAACTACTTGCACTATGGGTGATTTCACCCAGTCCTTTGATAT<br>TGTTGGCAGAAAGAAAAATTAATTTGGGTTTGAAGTGTGAAGGTCCCAAGCATCTGGTTGTTC<br>TTAATCAAATGTGTAAATTTCCAGTTGGAAGTTAGTCATATTTCAGTTACTTTCTTTTCAAACAG<br>ATAAAAAAATGAAATGCATATTCCCCCAGACAGTTGAATTCGATATCATAATCAACCATAGGTA<br>CCGAGCTCGGGATTCAGCCGGGAGCTTAGGGAGGGGAGGTCACTTCATAAGGGCCTGGGG<br>GGGGAGTTGGAGCCACGAGTCGTCCAGCCGGAGCCCCGTGTGGCTGAGCTCCGGCCTCAG<br>AAGCATCCCCGGGTTGGATCCTTCGAAGCTAGCGCTACCGGTCGCCACCATGGTGAGCAAG<br>GGCGAGGAGCTGTTCACCGGGGTGGTGCCCATCCTGGTCGAGCTGGACGGCGACGTAAAC<br>GGCCACAAGTTCAGCGTGTCCGGCGAGGGCGAGGGCGATGCCACCTACGGCAAGCTGACC<br>CTGAAGCTGATCTGCACCACCGGCAAGCTGCCCGTGCCCTGGCCCACCCTCGTGACCACCC<br>TGGGCTACGGCGTGCAGTGCTTCGCCCGCTACCCCGACCACATGAAGCAGCACGACTTCTT<br>CAAGTCCGCCATGCCCGAAGGCTACGTCCAGGAGCGCACCATCTTCTTCAAGGACGACGGC<br>AACTACAAGACCCGCGCCGAGGTGAAGTTCGAGGGCGACACCCTGGTGAACCGCATCGAGC |

| Fig 26 cont'd |
|---|
| Vector ID (length between ITRs) & Sequence Between ITRs |
| TGAAGGGCATCGACTTCAAGGAGGACGGCAACATCCTGGGGCACAAGCTGGAGTACAACTA<br>CAACAGCCACAACGTCTATATCACCGCCGACAAGCAGAAGAACGGCATCAAGGCCAACTTCA<br>AGATCCGCCACAACATCGAGGACGGCGGCGTGCAGCTCGCCGACCACTACCAGCAGAACAC<br>CCCCATCGGCGACGGCCCCGTGCTGCTGCCCGACAACCACTACCTGAGCTACCAGTCCAAG<br>CTGAGCAAAGACCCCAACGAGAAGCGCGATCACATGGTCCTGCTGGAGTTCGTGACCGCCG<br>CCGGGATCACTCTCGGCATGGACGAGCTGTACAAGTAAGTCGACATCATAATCAACCTCTGG<br>ATTACAAAATTTGTGAAAGATTGACTGGTATTCTTAACTATGTTGCTCCTTTTACGCTATGTGG<br>ATACGCTGCTTTAATGCCTTTGTATCATGCTATTGCTTCCCGTATGGCTTTCATTTTCTCCTCC<br>TTGTATAAATCCTGGTTAGTTCTTGCCACGGCGGAACTCATCGCCGCCTGCCTTGCCCGCTG<br>CTGGACAGGGGCTCGGCTGTTGGGCACTGACAATTCCGTGGCTCGAGAGATCTTCGACTGT<br>GCCTTCTAGTTGCCAGCCATCTGTTGTTTGCCCCTCCCCCGTGCCTTCCTTGACCCTGGAAG<br>GTGCCACTCCCACTGTCCTTTCCTAATAAAATGAGGAAATTGCATCGCATTGTCTGAGTAGGT<br>GTCATTCTATTCTGGGGGGTGGGGTGGGGCAGGACAGCAAGGGGGAGGATTGGGAAGACA<br>ATAGCAGGCATGCACGTGCGGACCGAGCGGCCGC (SEQ ID NO: 275) |
| CN1789 (2146)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTTTGAGATAAGCAGAGAGGGGAA<br>TAAAAAGAACAGAGATGGGCGGTGGGATGGAGAAGAGGAAGCAACAGAGAAAGTGTTTTTTT<br>AGAGCCAGTTACAAGTAATAAGGCTAGTGTCAGCTTCACACTAACTTGTTTACTGGCCTCCAC<br>TGATAGTGAGAAGAGCCACAATAGAGCTGAACAAATAGGGAGAATAAACAAGCTTGAAACAT<br>GCCCTACTTGGGAGGCAGCTTAATTACACAAACTGAAGTTCTGAAGCAAATAGAGGATCCTC<br>CAAGACTCCAGGGGCTCTGCTCTGCCAAGAGAAAGAAAGCACCTTATCCCTGGGCAGAGAAT<br>TTCATTCCAGAGGAGGGGGAGGGGCTGCTGTTGGTGGCTTTTGCAGTGGGTGGAGATAGAG<br>TAGAGAAGGCTTGCAGGGGTGGGCTGGCAGAGGGGAAGGGCCAACAATGAAGTTACAGATG<br>GATGAGTGGGTTTCTGCCACAAAATCAGATCAAGGAGAGGGAGGTGAAGAGGGAATTCGATA<br>TCATAATCAACCATAGGTACCGAGCTCGGGATTCAGCCGGGAGCTTAGGGAGGGGAGGTCA<br>CTTCATAAGGGCCTGGGGGGGGAGTTGGAGCCACGAGTCGTCCAGCCGGAGCCCCGTGTG<br>GCTGAGCTCCGGCCTCAGAAGCATCCCCGGGTTGGATCCTTCGAAGCTAGCGCTACCGGTC<br>GCCACCATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCGATGCC<br>ACCTACGGCAAGCTGACCCTGAAGCTGATCTGCACCACCGGCAAGCTGCCCGTGCCCTGGC<br>CCACCCTCGTGACCACCCTGGGCTACGGCGTGCAGTGCTTCGCCCGCTACCCCGACCACAT<br>GAAGCAGCACGACTTCTTCAAGTCCGCCATGCCCGAAGGCTACGTCCAGGAGCGCACCATC<br>TTCTTCAAGGACGACGGCAACTACAAGACCCGCGCCGAGGTGAAGTTCGAGGGCGACACCC<br>TGGTGAACCGCATCGAGCTGAAGGGCATCGACTTCAAGGAGGACGGCAACATCCTGGGGCA<br>CAAGCTGGAGTACAACTACAACAGCCACAACGTCTATATCACCGCCGACAAGCAGAAGAACG<br>GCATCAAGGCCAACTTCAAGATCCGCCACAACATCGAGGACGGCGGCGTGCAGCTCGCCGA<br>CCACTACCAGCAGAACACCCCCATCGGCGACGGCCCCGTGCTGCTGCCCGACAACCACTAC<br>CTGAGCTACCAGTCCAAGCTGAGCAAAGACCCCAACGAGAAGCGCGATCACATGGTCCTGC<br>TGGAGTTCGTGACCGCCGCCGGGATCACTCTCGGCATGGACGAGCTGTACAAGTAAGTCGA<br>CATCATAATCAACCTCTGGATTACAAAATTTGTGAAAGATTGACTGGTATTCTTAACTATGTTG<br>CTCCTTTTACGCTATGTGGATACGCTGCTTTAATGCCTTTGTATCATGCTATTGCTTCCCGTAT<br>GGCTTTCATTTTCTCCTCCTTGTATAAATCCTGGTTAGTTCTTGCCACGGCGGAACTCATCGC<br>CGCCTGCCTTGCCCGCTGCTGGACAGGGGCTCGGCTGTTGGGCACTGACAATTCCGTGGCT<br>CGAGAGATCTTCGACTGTGCCTTCTAGTTGCCAGCCATCTGTTGTTTGCCCCTCCCCCGTGC<br>CTTCCTTGACCCTGGAAGGTGCCACTCCCACTGTCCTTTCCTAATAAAATGAGGAAATTGCAT<br>CGCATTGTCTGAGTAGGTGTCATTCTATTCTGGGGGGTGGGGTGGGGCAGGACAGCAAGGG |

| Fig 26 cont'd |
| --- |
| Vector ID (length between ITRs) & Sequence Between ITRs |
| GGAGGATTGGGAAGACAATAGCAGGCATGCACGTGCGGACCGAGCGGCCGC (SEQ ID NO: 276) |
| CN1790 (2212)<br>GCGGCCGCAACGCGTTTAGAACAATGGCTGGCCCATAGTAAATGCCGTGTTAGTGTGTTAGT<br>TGCTGTTCTTCCACGTCAGAAGAGGCACAGACAAATTACCACCAGGTGGCGCTCAGAGTCTG<br>CGGAGGCATCACAACAGCCCTGAATTTGAATCCTGCTCTGCCACTGCCTAGTTGAGACCTTT<br>TACTACCTGACTAGCTGTTTGTGTATTTTAGGTGTTTGTTTCTGTTCTCGGCCCTAGGGACTT<br>GAGGTTGAGAGGTGGTGAGAAAAGACCCACACGCCACAAGCAGATGATGATTCCATCACAG<br>AAGGAGAGGAGGAGGCCTGGAGGAAGGCTTGTCTCATCCTAGCAACCAGAGGTTTTCTCTC<br>CTGGTGTGGCCCAGGAAAGTGAGAAGACGTTTCCTTCCAGCTATAGTCATGGAGCCACAAAG<br>TCGGGATTCAAGGCAAATTAGGCTGCTGATTTGTATGTTAAACAAGGTTAATTCCATCCATTA<br>GCCAAAGATGTTTTCAAAGCGCCTGGCACAAGAGCGAGGAGCAATTAGTGTCTTTGTATTAG<br>TGGATGTGGGCGTGGGGCCAGGACGTTAAGGGGAGGGGGATGCAATTTCTGCACTCTTTAT<br>GATATCATCAAAAGTAAATGAATTATGAAAACAAAAGAGGCAATATGAGGCTTCCAGTACTAAT<br>TACTGGGTAGGACAGAAAGTTCACAGTGAAGGAGGAAAGAATGATCAGAGAAGGACAAGGAT<br>ACGGATCATCTGGCCTGCAGGTGTCTTTAGACAAGGTGGGGCTTCCGTGACTCCAGAATTCG<br>ATATCATAATCAACCATAGGTACCGAGCTCGGGATTCAGCCGGGAGCTTAGGGAGGGGAGG<br>TCACTTCATAAGGGCCTGGGGGGGGGAGTTGGAGCCACGAGTCGTCCAGCCGGAGCCCCGT<br>GTGGCTGAGCTCCGGCCTCAGAAGCATCCCCGGGTTGGATCCTTCGAAGCTAGCGCTACCG<br>GTCGCCACCATGGTGAGCAAGGGCGAGGAGCTGTTCACCGGGGTGGTGCCCATCCTGGTC<br>GAGCTGGACGGCGACGTAAACGGCCACAAGTTCAGCGTGTCCGGCGAGGGCGAGGGCGAT<br>GCCACCTACGGCAAGCTGACCCTGAAGCTGATCTGCACCACCGGCAAGCTGCCCGTGCCCT<br>GGCCCACCCTCGTGACCACCCTGGGCTACGGCGTGCAGTGCTTCGCCCGCTACCCCGACCA<br>CATGAAGCAGCACGACTTCTTCAAGTCCGCCATGCCCGAAGGCTACGTCCAGGAGCGCACC<br>ATCTTCTTCAAGGACGACGGCAACTACAAGACCCGCGCCGAGGTGAAGTTCGAGGGCGACA<br>CCCTGGTGAACCGCATCGAGCTGAAGGGCATCGACTTCAAGGAGGACGGCAACATCCTGGG<br>GCACAAGCTGGAGTACAACTACAACAGCCACAACGTCTATATCACCGCCGACAAGCAGAAGA<br>ACGGCATCAAGGCCAACTTCAAGATCCGCCACAACATCGAGGACGGCGGCGTGCAGCTCGC<br>CGACCACTACCAGCAGAACACCCCCATCGGCGACGGCCCCGTGCTGCTGCCCGACAACCAC<br>TACCTGAGCTACCAGTCCAAGCTGAGCAAAGACCCCAACGAGAAGCGCGATCACATGGTCCT<br>GCTGGAGTTCGTGACCGCCGCCGGGATCACTCTCGGCATGGACGAGCTGTACAAGTAAGTC<br>GACATCATAATCAACCTCTGGATTACAAAATTTGTGAAAGATTGACTGGTATTCTTAACTATGT<br>TGCTCCTTTTACGCTATGTGGATACGCTGCTTTAATGCCTTTGTATCATGCTATTGCTTCCCGT<br>ATGGCTTTCATTTTCTCCTCCTTGTATAAATCCTGGTTAGTTCTTGCCACGGCGGAACTCATC<br>GCCGCCTGCCTTGCCCGCTGCTGGACAGGGGCTCGGCTGTTGGGCACTGACAATTCCGTGG<br>CTCGAGAGATCTTCGACTGTGCCTTCTAGTTGCCAGCCATCTGTTGTTTGCCCCTCCCCCGT<br>GCCTTCCTTGACCCTGGAAGGTGCCACTCCCACTGTCCTTTCCTAATAAAATGAGGAAATTGC<br>ATCGCATTGTCTGAGTAGGTGTCATTCTATTCTGGGGGGTGGGGTGGGGCAGGACAGCAAG<br>GGGGAGGATTGGGAAGACAATAGCAGGCATGCACGTGCGGACCGAGCGGCCGC (SEQ ID NO: 277) |
| CN2345 (1848)<br>GCGGCCGCACGCGTAGGAGCGAACATGGTATGCATAATTGAAACACTCCTCCTTGTTTGAAA<br>TGTTGTCTCCTCCTCTGCAGTCCTGCGGCAAAGACAGGCACACAGGCTTTCTCTGTGGATTA<br>ATTGGTCAGGAAAGACACTTTTTATATTGTCAAGTGGCACTTAAGCCATTAATTCTTGACTGTG<br>AAACTGCTTTTCCTGGGCAATGCTCTTTAAGGAAAAACTTATTCAGTCCAGTGACTGGTGACT<br>AAGGGAACGATGGAGCACAGGGAATTGGGCGGGATCTAGACTCCTAATAATGCCTCCTTAGC<br>CAATGAAAAGCATTTCCTATTGAGACCCCCAAGAGTTCCCCTGGCCGTCGGCTCCAGCTCGG<br>ACTTCAGGCCTTTTTGTGTCCTGTTTGCTAAAGGCATGCGGGCTACAGCATTCAAGAGAGGG<br>AGTCGTTAACAAAGGGAAAGAGATAAATGTAAATAAGCTCACATTTACAGAATGAGCGGTTTG |

| Fig 26 cont'd |
|---|
| Vector ID (length between ITRs) & Sequence Between ITRs |
| CAGTGAGCTCGGGCTGGGCATAAAAGTCAGGGCAGAGCCATCTATTGCTTACATTTGCTTCT GGGATCCAGATCTTTCGAAGCTAGCGCTACCGGTCGCCACCATGGTGAGCAAGGGCGAGGA GCTGTTCACCGGGGTGGTGCCCATCCTGGTCGAGCTGGACGGCGACGTAAACGGCCACAA GTTCAGCGTGTCCGGCGAGGGCGAGGGCGATGCCACCTACGGCAAGCTGACCCTGAAGCT GATCTGCACCACCGGCAAGCTGCCCGTGCCCTGGCCCACCCTCGTGACCACCCTGGGCTAC GGCGTGCAGTGCTTCGCCCGCTACCCCGACCACATGAAGCAGCACGACTTCTTCAAGTCCG CCATGCCCGAAGGCTACGTCCAGGAGCGCACCATCTTCTTCAAGGACGACGGCAACTACAA GACCCGCGCCGAGGTGAAGTTCGAGGGCGACACCCTGGTGAACCGCATCGAGCTGAAGGG CATCGACTTCAAGGAGGACGGCAACATCCTGGGGCACAAGCTGGAGTACAACTACAACAGC CACAACGTCTATATCACCGCCGACAAGCAGAAGAACGGCATCAAGGCCAACTTCAAGATCCG CCACAACATCGAGGACGGCGGCGTGCAGCTCGCCGACCACTACCAGCAGAACACCCCCATC GGCGACGGCCCCGTGCTGCTGCCCGACAACCACTACCTGAGCTACCAGTCCAAGCTGAGCA AAGACCCCAACGAGAAGCGCGATCACATGGTCCTGCTGGAGTTCGTGACCGCCGCCGGGAT CACTCTCGGCATGGACGAGCTGTACAAGTAAGTCGACGGCGCGCCGCGGCCGCGAATTCGA TATCATAATCAACCTCTGGATTACAAAATTTGTGAAAGATTGACTGGTATTCTTAACTATGTTG CTCCTTTTACGCTATGTGGATACGCTGCTTTAATGCCTTTGTATCATGCTATTGCTTCCCGTAT GGCTTTCATTTTCTCCTCCTTGTATAAATCCTGGTTAGTTCTTGCCACGGCGGAACTCATCGC CGCCTGCCTTGCCCGCTGCTGGACAGGGGCTCGGCTGTTGGGCACTGACAATTCCGTGGCT CGAGAGATCTTCGACTGTGCCTTCTAGTTGCCAGCCATCTGTTGTTTGCCCCTCCCCCGTGC CTTCCTTGACCCTGGAAGGTGCCACTCCCACTGTCCTTTCCTAATAAAATGAGGAAATTGCAT CGCATTGTCTGAGTAGGTGTCATTCTATTCTGGGGGGTGGGGTGGGGCAGGACAGCAAGGG GGAGGATTGGGAAGACAATAGCAGGCATGAGATCTCACGTGCGGACCGAGCGGCCGC (SEQ ID NO: 278) |
| CN2346 (1921) |
| GCGGCCGCACGCGTCCATTCTTTTGAAGTTGGCACTTTGATTTCTAGATGGTTCCCCAACACA GGTTCTTCTCCTCCTCATCATTATAGCTGCCTTGAAATTTGAGCTGGAAGGGAACATTCTGAG ACCCAGATTGTTAAATGTCTTTTCCAAAGTCATGCAATAAATTAAATGGCAAAGCCAGGGCAG TTTCTTGACTCAGTACAGGGTATTTTCTTTCATTCTTTACTCTTGAGACTTTAGAACTGTTGGTA CTGCTTTAAAATTCATGGCAAGAACTGGTCACTTTTGTAATTAACACCTCCTTATAATACATTT GTTTTGTTTGCTTAGCCAGCTAGAAACTACATGGAGTCTGTGCTTTAAAAAGCCTGCCGAAGT CCTTATTCTCTGTTTTGGTATTATGTGCATGAACCACCAATTGGTTCCTTCTCACCTTACACTT GATGAAGATGTCTTTCTTTCAACATCTTTCTCTATTGCTCCCCATCTTCTCTTGCTCTATTTATG ATCAGCTGTCTGTTTCTAAATAGACTTTGTGGTCACCCATTTCTTTTTGTGCCAGCTCCTATCC ACTGAGCTCGGGCTGGGCATAAAAGTCAGGGCAGAGCCATCTATTGCTTACATTTGCTTCTG GGATCCAGATCTTTCGAAGCTAGCGCTACCGGTCGCCACCATGGTGAGCAAGGGCGAGGAG CTGTTCACCGGGGTGGTGCCCATCCTGGTCGAGCTGGACGGCGACGTAAACGGCCACAAGT TCAGCGTGTCCGGCGAGGGCGAGGGCGATGCCACCTACGGCAAGCTGACCCTGAAGCTGA TCTGCACCACCGGCAAGCTGCCCGTGCCCTGGCCCACCCTCGTGACCACCCTGGGCTACGG CGTGCAGTGCTTCGCCCGCTACCCCGACCACATGAAGCAGCACGACTTCTTCAAGTCCGCC ATGCCCGAAGGCTACGTCCAGGAGCGCACCATCTTCTTCAAGGACGACGGCAACTACAAGA CCCGCGCCGAGGTGAAGTTCGAGGGCGACACCCTGGTGAACCGCATCGAGCTGAAGGGCA TCGACTTCAAGGAGGACGGCAACATCCTGGGGCACAAGCTGGAGTACAACTACAACAGCCA CAACGTCTATATCACCGCCGACAAGCAGAAGAACGGCATCAAGGCCAACTTCAAGATCCGCC ACAACATCGAGGACGGCGGCGTGCAGCTCGCCGACCACTACCAGCAGAACACCCCCATCGG CGACGGCCCCGTGCTGCTGCCCGACAACCACTACCTGAGCTACCAGTCCAAGCTGAGCAAA GACCCCAACGAGAAGCGCGATCACATGGTCCTGCTGGAGTTCGTGACCGCCGCCGGGATCA CTCTCGGCATGGACGAGCTGTACAAGTAAGTCGACGGCGCGCCGCGGCCGCGAATTCGATA TCATAATCAACCTCTGGATTACAAAATTTGTGAAAGATTGACTGGTATTCTTAACTATGTTGCT CCTTTTACGCTATGTGGATACGCTGCTTTAATGCCTTTGTATCATGCTATTGCTTCCCGTATGG |

| Fig 26 cont'd |
|---|
| Vector ID (length between ITRs) & Sequence Between ITRs |
| CTTTCATTTTCTCCTCCTTGTATAAATCCTGGTTAGTTCTTGCCACGGCGGAACTCATCGCCG CCTGCCTTGCCCGCTGCTGGACAGGGGCTCGGCTGTTGGGCACTGACAATTCCGTGGCTCG AGAGATCTTCGACTGTGCCTTCTAGTTGCCAGCCATCTGTTGTTTGCCCCTCCCCCGTGCCTT CCTTGACCCTGGAAGGTGCCACTCCCACTGTCCTTTCCTAATAAAATGAGGAAATTGCATCGC ATTGTCTGAGTAGGTGTCATTCTATTCTGGGGGGTGGGGTGGGGCAGGACAGCAAGGGGGA GGATTGGGAAGACAATAGCAGGCATGAGATCTCACGTGCGGACCGAGCGGCCGC (SEQ ID NO: 279) |
| CN2044 (2336) GCGGCCGCACGCGCCGGTACCGAAGCTACCCCTAACACACTATTCTACACACAGAAAATGCT CTTCACTAGGAAGCTACCCCTAACACACTATTCTACACACAGAAAATGCTCTTCACTAGGAAG CTACCCCTAACACACTATTCTACACACAGAAAATGCTCTTCACTAGACGCGTAGGTTGTGGCC ACTGTGACTCATATACATGTACATGAACGTATCTGAAGTTTTCAGGGCTGATACTGATGTGAG GCAACCCATGCAGGCAACCCGGAGGAACTGTGTCCCTCACTCTGAGACAGTGAGAACGGAC TGAGCCGGAAAGCTGATGGCCGTGAGAGGAGCAGGTTTGAAAATCACTGAATGAAGTCATGT TGTACAGAGGGGGCGGGGGTGCATACTGTGGGACGGAGGTGAGTCACAGTGCATAAGTGTT GGGGAGTCACCTTGAACTTGGGCCAGAAGAGTAGAAATATTGAGACTTGGGTTTATCTGCCT CACATCAGGTACATCAAGTTCTGGATGGCTGCCCACTGGCCAGAGACATGAGGTGGACGGC TCCCTTTTGCTGCCCTGGGAAGGCCTTCTGCTGGCTTCGGCCCCACTGAGCAAAGTCTGCTT GTTCACTGGAGTTCACACAGACTCCTTGCCAGGCCTGCCCAGAATCCTGTCTCCTCTGACTT CCTGTGCTCTTGCATAATATTTCCTTGCTCCCTGAATGGCTGGCCCCAGTGCAGGAGCAGCT CACTCACACTGCTGGACCGAGGGCAGGATGTAGAGGGAGGGCAGGGATCTGCAAACGTCAC CCAGGGGTGCTCTGGGCTCTGAGGGTGGAGGGCAAGAGGGGGCAGAGCCCCCTCAAATTCT TTGGAAGATTATAGCACAAGGGGAGTTGGGAAGGCCCTGGGACCATGTGCACACACATCTG AGCTCGATTCAGCCGGGAGCTTAGGGAGGGGAGGTCACTTCATAAGGGCTTGGGGGGGGGA GTTGGAGCCACGAGTCGTCCAGCCGGAGCCCCGTGTGGCTGTGCTCCGGCCTCAGAAGCAT CCCCGGATCCAGATCTTTCGAAGCTAGCGCTACCGGTCGCCACCATGGTGAGCAAGGGCGA GGAGCTGTTCACCGGGGTGGTGCCCATCCTGGTCGAGCTGGACGGCGACGTAAACGGCCA CAAGTTCAGCGTGTCCGGCGAGGGCGAGGGCGATGCCACCTACGGCAAGCTGACCCTGAA GCTGATCTGCACCACCGGCAAGCTGCCCGTGCCCTGGCCCACCCTCGTGACCACCCTGGGC TACGGCGTGCAGTGCTTCGCCCGCTACCCCGACCACATGAAGCAGCACGACTTCTTCAAGTC CGCCATGCCCGAAGGCTACGTCCAGGAGCGCACCATCTTCTTCAAGGACGACGGCAACTAC AAGACCCGCGCCGAGGTGAAGTTCGAGGGCGACACCCTGGTGAACCGCATCGAGCTGAAG GGCATCGACTTCAAGGAGGACGGCAACATCCTGGGGCACAAGCTGGAGTACAACTACAACA GCCACAACGTCTATATCACCGCCGACAAGCAGAAGAACGGCATCAAGGCCAACTTCAAGATC CGCCACAACATCGAGGACGGCGGCGTGCAGCTCGCCGACCACTACCAGCAGAACACCCCC ATCGGCGACGGCCCCGTGCTGCTGCCCGACAACCACTACCTGAGCTACCAGTCCAAGCTGA GCAAAGACCCCAACGAGAAGCGCGATCACATGGTCCTGCTGGAGTTCGTGACCGCCGCCGG GATCACTCTCGGCATGGACGAGCTGTACAAGTAAGTCGACGGCGCGCCGCGGCCGCGAATT CGATATCATAATCAACCTCTGGATTACAAAATTTGTGAAAGATTGACTGGTATTCTTAACTATG TTGCTCCTTTTACGCTATGTGGATACGCTGCTTTAATGCCTTTGTATCATGCTATTGCTTCCCG TATGGCTTTCATTTTCTCCTCCTTGTATAAATCCTGGTTAGTTCTTGCCACGGCGGAACTCATC GCCGCCTGCCTTGCCCGCTGCTGGACAGGGGCTCGGCTGTTGGGCACTGACAATTCCGTGG CTCGAGAGATCTTCGACTGTGCCTTCTAGTTGCCAGCCATCTGTTGTTTGCCCCTCCCCCGT GCCTTCCTTGACCCTGGAAGGTGCCACTCCCACTGTCCTTTCCTAATAAAATGAGGAAATTGC ATCGCATTGTCTGAGTAGGTGTCATTCTATTCTGGGGGGTGGGGTGGGGCAGGACAGCAAG GGGGAGGATTGGGAAGACAATAGCAGGCATGAGATCTCACGTGCGGACCGAGCGGCCGC (SEQ ID NO: 280) |
| CN2268 (1821) |

| Fig 26 cont'd |
| Vector ID (length between ITRs) & Sequence Between ITRs |

GCGGCCGCACGCGTGTAGACTGAGGCCCCGTGTCCAGAATAATTGTGCACTTCCACACACT
CGCAGTCCAGCACTGGAGTCTCAGCTGCTTGGCTCAGAGCTAGTGATACATCCCTGACCCCA
GAGACCCCCTGTGAGCCGGGGTTTCCTCGGGAGCTGCTGTATGAGCTTTCACCAGGCTGAG
TGTGTAGAGTAATGGGGTCTCCAGAGGAAGGGGGTGCCTCACAGGAGGGATGGGTAACTCC
GGAGTTTTGGATGCCCCCAGCTCCAGCATACCCAGCTCCTTCCAAGGCCACCCAGCCCCCG
CTGGCTTCAAACTTCACTGGCTTTTGGCAAATCCTGTTCCGCCAGGTCCTGAGAACGGCTGC
CGGTCGGAGCAAACTCAAAGGCCCTTTACAAAACCCAACAGCCCACCCAGGCCTTGGGCCC
CTCGTCTGTGATATGGAGGGCAGGTCCTCTTCGACTTCCCCAACCCCAGAGCTCGGGCTGG
GCATAAAAGTCAGGGCAGAGCCATCTATTGCTTACATTTGCTTCTGGGATCCAGATCTTTCGA
AGCTAGCGCTACCGGTCGCCACCATGGTGAGCAAGGGCGAGGAGCTGTTCACCGGGGTGG
TGCCCATCCTGGTCGAGCTGGACGGCGACGTAAACGGCCACAAGTTCAGCGTGTCCGGCGA
GGGCGAGGGCGATGCCACCTACGGCAAGCTGACCCTGAAGCTGATCTGCACCACCGGCAA
GCTGCCCGTGCCCTGGCCCACCCTCGTGACCACCCTGGGCTACGGCGTGCAGTGCTTCGC
CCGCTACCCCGACCACATGAAGCAGCACGACTTCTTCAAGTCCGCCATGCCCGAAGGCTAC
GTCCAGGAGCGCACCATCTTCTTCAAGGACGACGGCAACTACAAGACCCGCGCCGAGGTGA
AGTTCGAGGGCGACACCCTGGTGAACCGCATCGAGCTGAAGGGCATCGACTTCAAGGAGGA
CGGCAACATCCTGGGGCACAAGCTGGAGTACAACTACAACAGCCACAACGTCTATATCACCG
CCGACAAGCAGAAGAACGGCATCAAGGCCAACTTCAAGATCCGCCACAACATCGAGGACGG
CGGCGTGCAGCTCGCCGACCACTACCAGCAGAACACCCCCATCGGCGACGGCCCCGTGCT
GCTGCCCGACAACCACTACCTGAGCTACCAGTCCAAGCTGAGCAAAGACCCCAACGAGAAG
CGCGATCACATGGTCCTGCTGGAGTTCGTGACCGCCGCCGGGATCACTCTCGGCATGGACG
AGCTGTACAAGTAAGTCGACGGCGCGCCGCGGCCGCGAATTCGATATCATAATCAACCTCTG
GATTACAAAATTTGTGAAAGATTGACTGGTATTCTTAACTATGTTGCTCCTTTTACGCTATGTG
GATACGCTGCTTTAATGCCTTTGTATCATGCTATTGCTTCCCGTATGGCTTTCATTTTCTCCTC
CTTGTATAAATCCTGGTTAGTTCTTGCCACGGCGGAACTCATCGCCGCCTGCCTTGCCCGCT
GCTGGACAGGGGCTCGGCTGTTGGGCACTGACAATTCCGTGGCTCGAGAGATCTTCGACTG
TGCCTTCTAGTTGCCAGCCATCTGTTGTTTGCCCCTCCCCCGTGCCTTCCTTGACCCTGGAA
GGTGCCACTCCCACTGTCCTTTCCTAATAAAATGAGGAAATTGCATCGCATTGTCTGAGTAGG
TGTCATTCTATTCTGGGGGGTGGGGTGGGGCAGGACAGCAAGGGGGAGGATTGGGAAGAC
AATAGCAGGCATGAGATCTCACGTGCGGACCGAGCGGCCGC (SEQ ID NO: 281)

| CN2243 (1815) |

GCGGCCGCACGCGTTAAAAGGCCAGGGTGGGACCAGACTGCCCAGATAAGAGGCAGAGAC
ACTTGGAAGCAAGGCTTGAATGAGTAGTCAGCTAGTATTTATGTAGTGCTAGGCATGTTGGG
GGAAAACAGAAAAATTATAAGACGCCATGCAGTCCGTGGCGGAGCTTCTGGTGAGAGTCCCT
TGTGTAAGAATCAGGACTGGTGCCTGGTTCTGCCCAGCCGATGGAAGCCTGCCATGGTTTTT
GAGACTGGCTGGCTAGCCTCTGTGTAGAGCCACAGGGAGTAGTGGGCAAGCCAAGGGTCTA
GGAATGAATGAGTTGAGTCTGTGCCACGTACTACCAATGAGTCCCATTCCCTCTAAAGCTGA
GTTTCCATAGCTGTGCAATGTGAACCGCATCAAGACTTGCCAAGCCCGAGCATACCTCAGCA
GTTTATGGGAAGTGGAATAAGCCTAACAAATGTGGGTTCTGAGCTCGGGCTGGGCATAAAAG
TCAGGGCAGAGCCATCTATTGCTTACATTTGCTTCTGGGATCCAGATCTTTCGAAGCTAGCGC
TACCGGTCGCCACCATGGTGAGCAAGGGCGAGGAGCTGTTCACCGGGGTGGTGCCCATCCT
GGTCGAGCTGGACGGCGACGTAAACGGCCACAAGTTCAGCGTGTCCGGCGAGGGCGAGGG
CGATGCCACCTACGGCAAGCTGACCCTGAAGCTGATCTGCACCACCGGCAAGCTGCCCGTG
CCCTGGCCCACCCTCGTGACCACCCTGGGCTACGGCGTGCAGTGCTTCGCCCGCTACCCCG
ACCACATGAAGCAGCACGACTTCTTCAAGTCCGCCATGCCCGAAGGCTACGTCCAGGAGCG
CACCATCTTCTTCAAGGACGACGGCAACTACAAGACCCGCGCCGAGGTGAAGTTCGAGGGC
GACACCCTGGTGAACCGCATCGAGCTGAAGGGCATCGACTTCAAGGAGGACGGCAACATCC
TGGGGCACAAGCTGGAGTACAACTACAACAGCCACAACGTCTATATCACCGCCGACAAGCAG
AAGAACGGCATCAAGGCCAACTTCAAGATCCGCCACAACATCGAGGACGGCGGCGTGCAGC

| Fig 26 cont'd |
|---|
| Vector ID (length between ITRs) & Sequence Between ITRs |
| TCGCCGACCACTACCAGCAGAACACCCCCATCGGCGACGGCCCCGTGCTGCTGCCCGACAA CCACTACCTGAGCTACCAGTCCAAGCTGAGCAAAGACCCCAACGAGAAGCGCGATCACATG GTCCTGCTGGAGTTCGTGACCGCCGCCGGGATCACTCTCGGCATGGACGAGCTGTACAAGT AAGTCGACGGCGCGCCGCGGCCGCGAATTCGATATCATAATCAACCTCTGGATTACAAAATT TGTGAAAGATTGACTGGTATTCTTAACTATGTTGCTCCTTTTACGCTATGTGGATACGCTGCTT TAATGCCTTTGTATCATGCTATTGCTTCCCGTATGGCTTTCATTTTCTCCTCCTTGTATAAATC CTGGTTAGTTCTTGCCACGGCGGAACTCATCGCCGCCTGCCTTGCCCGCTGCTGGACAGGG GCTCGGCTGTTGGGCACTGACAATTCCGTGGCTCGAGAGATCTTCGACTGTGCCTTCTAGTT GCCAGCCATCTGTTGTTTGCCCCTCCCCCGTGCCTTCCTTGACCCTGGAAGGTGCCACTCCC ACTGTCCTTTCCTAATAAAATGAGGAAATTGCATCGCATTGTCTGAGTAGGTGTCATTCTATTC TGGGGGGTGGGGTGGGGCAGGACAGCAAGGGGGAGGATTGGGAAGACAATAGCAGGCATG AGATCTCACGTGCGGACCGAGCGGCCGC (SEQ ID NO: 282) |
| 3001 (3717) |
| GCGGCCGCACGCGTTCTACAAGTGTCTCTTCGAACCAAAGGACATGCCTGCTAAAGCATATT TTATAATCTCTTAAGAGCTGGAGTAAGCCTTAGTGTGGCAGGTCTGCGTGTCAAATAAAGGGT TTGAGATGACAGAACAGCAGCGTCCTCTCAGAAGGTCCAGCTGAGCCCCCAGGGTGAGGGG GTGACATGCTGTGCACAGTGGCCCTCATTTGAGCAGGAATGCCGTTCAGGTGCCTGCTGTG CCTCCCTGGTGCCAGGCCCAGCTGGCTCTCTACCATTCCAGCCCTCCTTTGCCACATCAGTT TGTTCTTAATTCCTTCTCGGAAACTCTGCTCCTTTGCCGCACACCACGTGTTCAGCCAGGCCC CATCTGACAGCTGGGGCCCCTGGCGCAACCCCACAGACACCCAGTGTCCCTTTCACAGGCT CCGGTGAGCCAAGTCTACTTCCTTTACAACCCTTTTATAGGCCCTCCCATTCTGGAGCCTTGT GTGCCATGCCAATGGCTTACACACTTGATGAAAGGACTCAGGGGCTGAGAACTTGGATCAAT GAGGTCTTTATTTTTGAACATCAGTAAACAGCACAAATCAGTTGAATGGGTGCAGCCCTGTTC GTAATTCCAATGCTTGCTGTGGTTTCCAGCCAGCATTAGACACACAGAGAAAGTGCTCGTTAA TGCTAGCTAATGAAGAATGTGGCCCTTTTTCCCTAACTTGAACACACTCCAAGACGCTGGCCT GAAAGATCAGTGTGACACTGGAGAGGGTGAATGGGAAAATCTTTAACCTTCCTTTTGAAACAG CCCATTGACGTGGCTCTAACCACTTTCTTTCCTCTTCTTTTTGGTCTGCTCTCTGGCATTGCG GGATCAGCTTGACGCAAAATACAATCTTTTTTAAGACCCAGAAAATCGTGCCAGGACCGTTTC ACTAACTGAACTACAAATCGTGTAATTAGAGATGAAAAGTCCCAGGAACCTTCAACTTGTGCC TGTGCCTTTGTCAAAGTGGACCCCTGTCACTGTGTTTTGGGGGGTTGTTCTTGTCACTCTTGCT GTTTATTTGTGAAACCACTCACAGCTCATTCAGTGCCACCAGCAAGGGACATGGCCTCCTTGT TTCAACTAAAAATAGTCATTGGTGTGGTTAAAACCACAGGAAAGTAATCTTTAAAAAGATTTAG AGCTCGGGCTGGGCATAAAAGTCAGGGCAGAGCCATCTATTGCTTACATTTGCTTCTGGCGT GGCCACCATGGCTCCTAAGAAGAAGAGGAAGGTGATGAGCCAGTTCGACATCCTGTGCAAG ACCCCCCCCAAGGTGCTGGTGCGGCAGTTCGTGGAGAGATTCGAGAGGCCCAGCGGCGAG AAGATCGCCAGCTGTGCCGCCGAGCTGACCTACCTGTGCTGGATGATCACCCACAACGGCA CCGCCATCAAGAGGGCCACCTTCATGAGCTACAACACCATCATCAGCAACAGCCTGAGCTTC GACATCGTGAACAAGAGCCTGCAGTTCAAGTACAAGACCCAGAAGGCCACCATCCTGGAGG CCAGCCTGAAGAAGCTGATCCCCGCCTGGGAGTTCACCATCATCCCTTACAACGGCCAGAA GCACCAGAGCGACATCACCGACATCGTGTCCAGCCTGCAGCTGCAGTTCGAGAGCAGCGAG GAGGCCGACAAGGGCAACAGCCACAGCAAGAAGATGCTGAAGGCCCTGCTGTCCGAGGGC GAGAGCATCTGGGAGATCACCGAGAAGATCCTGAACAGCTTCGAGTACACCAGCAGGTTCA CCAAGACCAAGACCCTGTACCAGTTCCTGTTCCTGGCCACATTCATCAACTGCGGCAGGTTC AGCGACATCAAGAACGTGGACCCCAAGAGCTTCAAGCTGGTGCAGAACAAGTACCTGGGCG TGATCATTCAGTGCCTGGTGACCGAGACCAAGACAAGCGTGTCCAGGCACATCTACTTTTTC AGCGCCAGAGGCAGGATCGACCCCCTGGTGTACCTGGACGAGTTCCTGAGGAACAGCGAG CCCGTGCTGAAGAGAGTGAACAGGACCGGCAACAGCAGCAGCAACAAGCAGGAGTACCAGC TGCTGAAGGACAACCTGGTGCGCAGCTACAACAAGGCCCTGAAGAAGAACGCCCCCTACCC CATCTTCGCTATCAAGAACGGCCCTAAGAGCCACATCGGCAGGCACCTGATGACCAGCTTTC |

| Fig 26 cont'd |
| --- |
| Vector ID (length between ITRs) & Sequence Between ITRs |

TGAGCATGAAGGGCCTGACCGAGCTGACAAACGTGGTGGGCAACTGGAGCGACAAGAGGG
CCTCCGCCGTGGCCAGGACCACCTACACCCACCAGATCACCGCCATCCCCGACCACTACTT
CGCCCTGGTGTCCAGGTACTACGCCTACGACCCCATCAGCAAGGAGATGATCGCCCTGAAG
GACGAGACCAACCCCATCGAGGAGTGGCAGCACATCGAGCAGCTGAAGGGCAGCGCCGAG
GGCAGCATCAGATACCCCGCCTGGAACGGCATCATCAGCCAGGAGGTGCTGGACTACCTGA
GCAGCTACATCAACAGGCGGATCTGAGAATTCGATATCAAGCTTATCGATAATCAACCTCTGG
ATTACAAAATTTGTGAAAGATTGACTGGTATTCTTAACTATGTTGCTCCTTTTACGCTATGTGG
ATACGCTGCTTTAATGCCTTTGTATCATGCTATTGCTTCCCGTATGGCTTTCATTTTCTCCTCC
TTGTATAAATCCTGGTTGCTGTCTCTTTATGAGGAGTTGTGGCCCGTTGTCAGGCAACGTGG
CGTGGTGTGCACTGTGTTTGCTGACGCAACCCCCACTGGTTGGGGCATTGCCACCACCTGT
CAGCTCCTTTCCGGGACTTTCGCTTTCCCCCTCCCTATTGCCACGGCGGAACTCATCGCCGC
CTGCCTTGCCCGCTGCTGGACAGGGGCTCGGCTGTTGGGCACTGACAATTCCGTGGTGTTG
TCGGGGAAATCATCGTCCTTTCCTTGGCTGCTCGCCTATGTTGCCACCTGGATTCTGCGCGG
GACGTCCTTCTGCTACGTCCCTTCGGCCCTCAATCCAGCGGACCTTCCTTCCCGCGGCCTGC
TGCCGGCTCTGCGGCCTCTTCCGCGTCTTCGCCTTCGCCCTCAGACGAGTCGGATCTCCCTT
TGGGCCGCCTCCCCGCATCGATACCGAGCGCTGCTCGAGAGATCTACGGGTGGCATCCCTG
TGACCCCTCCCCAGTGCCTCTCCTGGCCCTGGAAGTTGCCACTCCAGTGCCCACCAGCCTT
GTCCTAATAAAATTAAGTTGCATCATTTTGTCTGACTAGGTGTCCTTCTATAATATTATGGGGT
GGAGGGGGGTGGTATGGAGCAAGGGGCAAGTTGGGAAGACAACCTGTAGGGCCTGCGGGG
TCTATTGGGAACCAAGCTGGAGTGCAGTGGCACAATCTTGGCTCACTGCAATCTCCGCCTCC
TGGGTTCAAGCGATTCTCCTGCCTCAGCCTCCCGAGTTGTTGGGATTCCAGGCATGCATGAC
CAGGCTCAGCTAATTTTTGTTTTTTTTGGTAGAGACGGGGTTTCACCATATTGGCCAGGCTGGT
CTCCAACTCCTAATCTCAGGTGATCTACCCACCTTGGCCTCCCAAATTGCTGGGATTACAGG
CGTGAACCACTGCTCCCTTCCCTGTCCTTCTGATTTTGTAGGTAACCACGTGCGGACCGAGC
GGCCGC (SEQ ID NO: 283)

3002 (3686)
GCGGCCGCACGCGTCACTTGCAGGTTTCTTCTTCCAGTCCCAGCCCTCTGGCCCACACCCC
ACTGCTGACCACAGGAGCCTCTCACAGTGCTCACTCAGGGCTTCAAAACTCTCTCCCTGGCA
GCTTCTTTCTATTCTGAAGTCTCCCAGTCCAGCACAAATTAGTCCCCTCTCCTGGACTCCTAC
TGCGCCGCCTTGGTACATCACAGAGCACTGGCTGAGAAAATCGCCCTTTAGTCCCCGCAAAT
CACTCTCTTACCTGCTCCACTGACTAGGCCTGTGCCATTATTTATTAGGGAATGAGCGCTAGC
TGTTGAGGGTCAATTATTCCATTGACCAGGCATTACAATAATTCCTGGTAATTAAAAGAGGTA
CTTATGTGAATCTGGATGCGTATTGAAAGAAACATTAGTCCTTTTGTCAGCTTGGCAAGTCTAT
TGTTCTGAGCCAGGCCCAACCAATTAACATCTTTTGCCAATCCCTGTCAGCAGGGGCTTGCA
AGGAGGAGAGAAAGGGGGGCCGGTCAGATGCTAATTTAGATACAATTGTGTCAGGGTGCAT
GGGAGGGGTAACTCTGAAGAAGAGACTCCAGTTTAATGAAGCAAACAGCTTGGGTCCCAGTG
ACCCTGCAGGGGTAATTTTAAAAGGCCCCTCTGTGTTCCTGTGCCAAATTGCAGAGGGCCAG
CAACAAGAAGCCCTTCAAAAAAAAAAAAAAGAGGGAGCAGGATAATCATCCACTTAATCTGCTC
ATTAAACAAATCTCTCAGGCGGACTTAACGTGAATTAGCACTTCTCTGAAAGGGGCAGCCTTG
ATGAGCAGCAGACAGCTCAGATCATTTGGAAGGTCACAGTTTTTTTTTTATTATTATATAAGCC
CAGTTGTTATTAATGTATTCATATTTGAAGAAACTGAGCAGAGACCTGCTTTCATTCAATCTAG
TGAGCAAAACAGTACGTTTTCCTAACTGGAAAACAAAACATAAATGCTAATCAGGTCCCAGCA
GAGATCAAATCAAGCTAAATATAGCAGGCACCCTTTGTGGTTTTTTTTTGTTTTGTTTTGTTTTG
TTTTTTGTTTTTTTTTAATACAGAAATTAAGGAAAGAAAAAAAACCATTGAATTAATTGTCTTCC
TCTGTGCTTCGCACCTGACACCAGCGGAGCTCGGGCTGGGCATAAAAGTCAGGGCAGAGCC
ATCTATTGCTTACATTTGCTTCTGGCGTGGCCACCATGGCTCCTAAGAAGAAGAGGAAGGTG
ATGAGCCAGTTCGACATCCTGTGCAAGACCCCCCCCAAGGTGCTGGTGCGGCAGTTCGTGG
AGAGATTCGAGAGGCCCAGCGGCGAGAAGATCGCCAGCTGTGCCGCCGAGCTGACCTACCT
GTGCTGGATGATCACCCACAACGGCACCGCCATCAAGAGGGCCACCTTCATGAGCTACAAC

| Fig 26 cont'd |
| --- |
| Vector ID (length between ITRs) & Sequence Between ITRs |
| ACCATCATCAGCAACAGCCTGAGCTTCGACATCGTGAACAAGAGCCTGCAGTTCAAGTACAA<br>GACCCAGAAGGCCACCATCCTGGAGGCCAGCCTGAAGAAGCTGATCCCCGCCTGGGAGTTC<br>ACCATCATCCCTTACAACGGCCAGAAGCACCAGAGCGACATCACCGACATCGTGTCCAGCCT<br>GCAGCTGCAGTTCGAGAGCAGCGAGGAGGCCGACAAGGGCAACAGCCACAGCAAGAAGAT<br>GCTGAAGGCCCTGCTGTCCGAGGGCGAGAGCATCTGGGAGATCACCGAGAAGATCCTGAAC<br>AGCTTCGAGTACACCAGCAGGTTCACCAAGACCAAGACCCTGTACCAGTTCCTGTTCCTGGC<br>CACATTCATCAACTGCGGCAGGTTCAGCGACATCAAGAACGTGGACCCCAAGAGCTTCAAGC<br>TGGTGCAGAACAAGTACCTGGGCGTGATCATTCAGTGCCTGGTGACCGAGACCAAGACAAG<br>CGTGTCCAGGCACATCTACTTTTTCAGCGCCAGAGGCAGGATCGACCCCCTGGTGTACCTG<br>GACGAGTTCCTGAGGAACAGCGAGCCCGTGCTGAAGAGAGTGAACAGGACCGGCAACAGCA<br>GCAGCAACAAGCAGGAGTACCAGCTGCTGAAGGACAACCTGGTGCGCAGCTACAACAAGGC<br>CCTGAAGAAGAACGCCCCCTACCCCATCTTCGCTATCAAGAACGGCCCTAAGAGCCACATCG<br>GCAGGCACCTGATGACCAGCTTTCTGAGCATGAAGGGCCTGACCGAGCTGACAAACGTGGT<br>GGGCAACTGGAGCGACAAGAGGGCCTCCGCCGTGGCCAGGACCACCTACACCCACCAGAT<br>CACCGCCATCCCCGACCACTACTTCGCCCTGGTGTCCAGGTACTACGCCTACGACCCCATCA<br>GCAAGGAGATGATCGCCCTGAAGGACGAGACCAACCCCATCGAGGAGTGGCAGCACATCGA<br>GCAGCTGAAGGGCAGCGCCGAGGGCAGCATCAGATACCCCGCCTGGAACGGCATCATCAG<br>CCAGGAGGTGCTGGACTACCTGAGCAGCTACATCAACAGGCGGATCTGAGAATTCGATATCA<br>AGCTTATCGATAATCAACCTCTGGATTACAAAATTTGTGAAAGATTGACTGGTATTCTTAACTA<br>TGTTGCTCCTTTTACGCTATGTGGATACGCTGCTTTAATGCCTTTGTATCATGCTATTGCTTCC<br>CGTATGGCTTTCATTTTCTCCTCCTTGTATAAATCCTGGTTGCTGTCTCTTTATGAGGAGTTGT<br>GGCCCGTTGTCAGGCAACGTGGCGTGGTGTGCACTGTGTTTGCTGACGCAACCCCCACTGG<br>TTGGGGCATTGCCACCACCTGTCAGCTCCTTTCCGGGACTTTCGCTTTCCCCCTCCCTATTG<br>CCACGGCGGAACTCATCGCCGCCTGCCTTGCCCGCTGCTGGACAGGGGCTCGGCTGTTGG<br>GCACTGACAATTCCGTGGTGTTGTCGGGGAAATCATCGTCCTTTCCTTGGCTGCTCGCCTAT<br>GTTGCCACCTGGATTCTGCGCGGGACGTCCTTCTGCTACGTCCCTTCGGCCCTCAATCCAGC<br>GGACCTTCCTTCCCGCGGCCTGCTGCCGGCTCTGCGGCCTCTTCCGCGTCTTCGCCTTCGC<br>CCTCAGACGAGTCGGATCTCCCTTTGGGCCGCCTCCCCGCATCGATACCGAGCGCTGCTCG<br>AGAGATCTACGGGTGGCATCCCTGTGACCCCTCCCCAGTGCCTCTCCTGGCCCTGGAAGTT<br>GCCACTCCAGTGCCCACCAGCCTTGTCCTAATAAAATTAAGTTGCATCATTTTGTCTGACTAG<br>GTGTCCTTCTATAATATTATGGGGTGGAGGGGGGTGGTATGGAGCAAGGGGCAAGTTGGGA<br>AGACAACCTGTAGGGCCTGCGGGGTCTATTGGGAACCAAGCTGGAGTGCAGTGGCACAATC<br>TTGGCTCACTGCAATCTCCGCCTCCTGGGTTCAAGCGATTCTCCTGCCTCAGCCTCCCGAGT<br>TGTTGGGATTCCAGGCATGCATGACCAGGCTCAGCTAATTTTTGTTTTTTTGGTAGAGACGGG<br>GTTTCACCATATTGGCCAGGCTGGTCTCCAACTCCTAATCTCAGGTGATCTACCCACCTTGGC<br>CTCCCAAATTGCTGGGATTACAGGCGTGAACCACTGCTCCCTTCCCTGTCCTTCTGATTTTGT<br>AGGTAACCACGTGCGGACCGAGCGGCCGC (SEQ ID NO: 284) |
| 3003 (3929)<br>GCGGCCGCACGCGTGACTCCTTTCCCGTTTCCATCAAACCTCCCCCCTGCACACATGCAAGA<br>CCAGTTTTATTTTTGTTGAGCTACACATTCGGTTCCCTCTTCTCTCCGGTCTCATTAACTCCAC<br>TCCGTCAGATTCCCCGCTTTTCTAATGATTAAAGTCGTGGGCTTTTTAAAAAGGCCTCCAAT<br>TAGCACCTCATCAGCTCCAATTAGAGCAGACAAAGGCCGTGTAAAGATAACTCAGTGAGAGG<br>GGCGGGAGCAACATCATGTAATCACTTAAGACAGGCTTTGAGAATTCTCCCAGCGACCCACA<br>CTGGGCCTATTCACCTTTCTTTCTTCCTTTTGGATGCATTTAAGACTGTTTGGCTGGGAAGAC<br>AGGCCCCCAGGAGTCTCATAATTCCTCATTCACAGGCTACCTGTTTACTTCTGGGAGAGTC<br>CAAGGACCTAAACAATCCCATATTGTACGCCTGCTTCCTTAAATTCCAGATCCCTAATCGTGT<br>GTTTTTGGTGGCCCTCAGAACAAGTTAAAGGCCAGCTTTATACTCCCAGAGGGTTCTCCTTGT<br>ACTGTCTTCTAATTACAGGAGAGAGTAACAATGTATTTTTTTTTTCAATGAGAGTTCTTTGGAG<br>CAGTTAATTTGGTGCCTGTACTAAATGCCCCCAAACATTAATTAGGGTGGAAGAAACCCTAAT |

| Fig 26 cont'd |
|---|
| Vector ID (length between ITRs) & Sequence Between ITRs |
| TCCCTCAGCAGCGTTGCCCTCCATTTAGTTCCCTCGTTTTTCACATAGGCCTGGACGAGTCTC |
| CATAATGAAATTACCTCATTAATGCCTTTATTCTTCACAGTAACTCATTCAAAACCGACCATTTA |
| GCTTTAATTGAATGCTGTCAAAAGGAAAGAGGTGCATTCATGGCTTTGATTAGCAAAAAATTTT |
| CCCCCCTGAGGGGCAGACAGATTTAAATTATGAAGATGGTGAGTAGTGAGTTATAATTGGGT |
| ACAAGCAGCACTTTAGGAGAGCTGAAACGTTTTCAAAGCCGGGGTTGGCCAGTCTGCGGACT |
| ATTAACTACGTCCAGGGCCTTGTTCTCTGTTTGAATTGATGGCAACTTAACTATCCAAAAGAAA |
| ATGGGGTTTACTTTTTGTTTAATACACAGTGGGGTTCTATTTACCCACAGAGCGATCGTTTCTT |
| CATGAGCTCTATCTTTGTTCCCCTGATAATTTATTATTTGTGCTTTCTAACACGGGTGCTGGAG |
| GGCGCCAGCGCCGTGCATGGTGCAGTTTCCGGGGAGAGTTAGAATAGAGAGTGCACATATT |
| GAGCAACTGGGCTGCTGGCCCAGCGCCTCCCTGGGGCAGACACAGCGAGGTGAAGCCCCG |
| AGTCAGGAGCAAGTGGGTGCAGTGGAACCTTGGGAACTCAGCCCTCAGAAAGTCTGCTCTG |
| ACTTGATGCAACAATGCTGGAGCTCGGGCTGGGCATAAAAGTCAGGGCAGAGCCATCTATTG |
| CTTACATTTGCTTCTGGCGTGGCCACCATGGCTCCTAAGAAGAAGAGGAAGGTGATGAGCCA |
| GTTCGACATCCTGTGCAAGACCCCCCCCAAGGTGCTGGTGCGGCAGTTCGTGGAGAGATTC |
| GAGAGGCCCAGCGGCGAGAAGATCGCCAGCTGTGCCGCCGAGCTGACCTACCTGTGCTGG |
| ATGATCACCCACAACGGCACCGCCATCAAGAGGGCCACCTTCATGAGCTACAACACCATCAT |
| CAGCAACAGCCTGAGCTTCGACATCGTGAACAAGAGCCTGCAGTTCAAGTACAAGACCCAGA |
| AGGCCACCATCCTGGAGGCCAGCCTGAAGAAGCTGATCCCCGCCTGGGAGTTCACCATCAT |
| CCCTTACAACGGCCAGAAGCACCAGAGCGACATCACCGACATCGTGTCCAGCCTGCAGCTG |
| CAGTTCGAGAGCAGCGAGGAGGCCGACAAGGGCAACAGCCACAGCAAGAAGATGCTGAAG |
| GCCCTGCTGTCCGAGGGCGAGAGCATCTGGGAGATCACCGAGAAGATCCTGAACAGCTTCG |
| AGTACACCAGCAGGTTCACCAAGACCAAGACCCTGTACCAGTTCCTGTTCCTGGCCACATTC |
| ATCAACTGCGGCAGGTTCAGCGACATCAAGAACGTGGACCCCAAGAGCTTCAAGCTGGTGC |
| AGAACAAGTACCTGGGCGTGATCATTCAGTGCCTGGTGACCGAGACCAAGACAAGCGTGTC |
| CAGGCACATCTACTTTTTCAGCGCCAGAGGCAGGATCGACCCCCTGGTGTACCTGGACGAG |
| TTCCTGAGGAACAGCGAGCCCGTGCTGAAGAGAGTGAACAGGACCGGCAACAGCAGCAGCA |
| ACAAGCAGGAGTACCAGCTGCTGAAGGACAACCTGGTGCGCAGCTACAACAAGGCCCTGAA |
| GAAGAACGCCCCCTACCCCATCTTCGCTATCAAGAACGGCCCTAAGAGCCACATCGGCAGG |
| CACCTGATGACCAGCTTTCTGAGCATGAAGGGCCTGACCGAGCTGACAAACGTGGTGGGCA |
| ACTGGAGCGACAAGAGGGCCTCCGCCGTGGCCAGGACCACCTACACCCACCAGATCACCG |
| CCATCCCCGACCACTACTTCGCCCTGGTGTCCAGGTACTACGCCTACGACCCCATCAGCAAG |
| GAGATGATCGCCCTGAAGGACGAGACCAACCCCATCGAGGAGTGGCAGCACATCGAGCAGC |
| TGAAGGGCAGCGCCGAGGGCAGCATCAGATACCCCGCCTGGAACGGCATCATCAGCCAGG |
| AGGTGCTGGACTACCTGAGCAGCTACATCAACAGGCGGATCTGAGAATTCGATATCAAGCTT |
| ATCGATAATCAACCTCTGGATTACAAAATTTGTGAAAGATTGACTGGTATTCTTAACTATGTTG |
| CTCCTTTTACGCTATGTGGATACGCTGCTTTAATGCCTTTGTATCATGCTATTGCTTCCCGTAT |
| GGCTTTCATTTTCTCCTCCTTGTATAAATCCTGGTTGCTGTCTCTTTATGAGGAGTTGTGGCC |
| CGTTGTCAGGCAACGTGGCGTGGTGTGCACTGTGTTTGCTGACGCAACCCCCACTGGTTGG |
| GGCATTGCCACCACCTGTCAGCTCCTTTCCGGGACTTTCGCTTTCCCCCTCCCTATTGCCAC |
| GGCGGAACTCATCGCCGCCTGCCTTGCCCGCTGCTGGACAGGGGCTCGGCTGTTGGGCAC |
| TGACAATTCCGTGGTGTTGTCGGGGAAATCATCGTCCTTTCCTTGGCTGCTCGCCTATGTTG |
| CCACCTGGATTCTGCGCGGGACGTCCTTCTGCTACGTCCCTTCGGCCCTCAATCCAGCGGA |
| CCTTCCTTCCCGCGGCCTGCTGCCGGCTCTGCGGCCTCTTCCGCGTCTTCGCCTTCGCCCT |
| CAGACGAGTCGGATCTCCCTTTGGGCCGCCTCCCCGCATCGATACCGAGCGCTGCTCGAGA |
| GATCTACGGGTGGCATCCCTGTGACCCCTCCCCAGTGCCTCTCCTGGCCCTGGAAGTTGCC |
| ACTCCAGTGCCCACCAGCCTTGTCCTAATAAAATTAAGTTGCATCATTTTGTCTGACTAGGTG |
| TCCTTCTATAATATTATGGGGTGGAGGGGGGTGGTATGGAGCAAGGGGCAAGTTGGGAAGA |
| CAACCTGTAGGGCCTGCGGGGTCTATTGGGAACCAAGCTGGAGTGCAGTGGCACAATCTTG |
| GCTCACTGCAATCTCCGCCTCCTGGGTTCAAGCGATTCTCCTGCCTCAGCCTCCCGAGTTGT |

| Fig 26 cont'd |
| Vector ID (length between ITRs) & Sequence Between ITRs |

TGGGATTCCAGGCATGCATGACCAGGCTCAGCTAATTTTTGTTTTTTTGGTAGAGACGGGGTT
TCACCATATTGGCCAGGCTGGTCTCCAACTCCTAATCTCAGGTGATCTACCCACCTTGGCCT
CCCAAATTGCTGGGATTACAGGCGTGAACCACTGCTCCCTTCCCTGTCCTTCTGATTTTGTAG
GTAACCACGTGCGGACCGAGCGGCCGC (SEQ ID NO: 285)

3004 (4204)
GCGGCCGCACGCGTTATTTTATAGGCATAGACTTTGCCATGTAAGCCAAGCTAAGTATCCCT
GGACCTTCAAGTGATCTGCCTGCCTCTGCCTCCTCCACCATCATGAAGCTCACCATTGTCAC
AGCAGTTTTTTACCTGGATGCTGGGGAATCTGAACTCAGGTTGTCACATTTGCAAGGCTGGTA
CTTTACCAACTGAACTACCTCTTTGGCCCTACTTTTTTTGTTTTCTTGAGAATGTTCTAGAAAG
CTCTCTGTTAGGTAATATTTTTTTTCATTTGAAGTTCAATCTTCCCTTTCTGTTTCTAAGACTCT
CAGAGAAAATTAAACATTTATTCTTCTATTAAGCTTGGACAAGTACTAAGATTAAAAAAAAAAAA
AGCAAAATTAGCATTGCTTTTTCAAGGCAAAAGCAAAGACAGTTCCTTTATTTAATAACCTTCA
CTCATACAAGAACCAAGCTCATTAGTCAAGTATTGGCCACAGAAAATGAAACTCTTAAGTCTC
CATGAAATAATGTCTTTGGTCCTATTTAGCCGAGTGAAGGATTTAGACACAAAGCAAACAGAA
ACTTGAAATCTGGTCTTCTCTTCTCTCCAGAATATTTGGTCTAAAGTAGGTCAGACCCTGCTG
CAACTAATCTTAACACTTCTTTTGATTCTTTCACTGGCTCTACTTAGAGGAGCTTAGAGAGGG
GAAAATTCATCCAATTAGTTAAAGAAAAACTGCAAATGAGAGAAAAGGCCTCCTGAATTGTGG
TGCGGGGTCTCTGTCTCCAGCGCCAATGAGTTCATCAACTTGAAAATGATTTTCAAAAGAATA
GCTGTCTATGAGGTAATCATTAATCCCCCGGATGCTTTAGTGGCTGCCCTGGCTGCCCTCAA
CCATCCATTCTCTCTCCTGGAGTCTAAGAAGGATGCTGACACAGCTCTGGATGAAGCCAAGA
CCATGCCTCAAGAGAAGAAGAGAAACCTAGAATGACCCTCAGTCCTTCAAGACAGCCATCGC
TTCCCAAAAAAAGGCCCAGCAAGGGGTTTCAAAACTCTAGAGTTCAGAAGAAAGTTGCCAGG
AGGGGCCTGGATTTTGAAGGTGTGTAGAGGAAGGGAGTCCACTGAAGGTGTTCATAGTCTAC
ATTGGTGTGTGCACATAGCGTCTAAATCCAAGCCGTTGCTTTTCCTTGGCCTCTCCCATGGAT
TCCCACCCGAACCACAGAGTGGGACCCTTGTTTCCAAGAGTACTTTCGCCAAAAAAGTGCAC
AGCTTTTCACCACTTACGTGAAATGCTGCCAGCTAAATATCCTTCTGAATGATGTCTTTGAGA
CTTCCCAGGCACTTAAGCTCCTTTCTAAACCATCACAGGCCAACAAAGTCTGTGAGGTTTTAA
GGGATTTTTGCTGGTCCCGTGGCTTATTCTTTGACCACATCAAAATCCAAGGGATTGCTCCAG
AAACTGTGGATACAGTTTCTTTTCTTGTTGCTATGACCAAAGCAACTAAAGAAGGATTTGTGTA
GCTCACTGTTTGAGGGTGTGATCCATCGCAAAGAGGGAAGGCGTGGGGACAGGTTCATGAG
ACAGCTATTCACACTGTATGAGAGGCCCTGAAGCAGGGGAGAAATGCTGGTATGCTGGTGCT
CACTTTTCTTTCTTTCTTTCTTTCTTTCTTTCTTTTTTTTTGAGCTCGGGCTGGGCATAAAAGTC
AGGGCAGAGCCATCTATTGCTTACATTTGCTTCTGGCGTGGCCACCATGGCTCCTAAGAAGA
AGAGGAAGGTGATGAGCCAGTTCGACATCCTGTGCAAGACCCCCCCCAAGGTGCTGGTGCG
GCAGTTCGTGGAGAGATTCGAGAGGCCCAGCGGCGAGAAGATCGCCAGCTGTGCCGCCGA
GCTGACCTACCTGTGCTGGATGATCACCCACAACGGCACCGCCATCAAGAGGGCCACCTTC
ATGAGCTACAACACCATCATCAGCAACAGCCTGAGCTTCGACATCGTGAACAAGAGCCTGCA
GTTCAAGTACAAGACCCAGAAGGCCACCATCCTGGAGGCCAGCCTGAAGAAGCTGATCCCC
GCCTGGGAGTTCACCATCATCCCTTACAACGGCCAGAAGCACCAGAGCGACATCACCGACAT
CGTGTCCAGCCTGCAGCTGCAGTTCGAGAGCAGCGAGGAGGCCGACAAGGGCAACAGCCA
CAGCAAGAAGATGCTGAAGGCCCTGCTGTCCGAGGGCGAGAGCATCTGGGAGATCACCGAG
AAGATCCTGAACAGCTTCGAGTACACCAGCAGGTTCACCAAGACCAAGACCCTGTACCAGTT
CCTGTTCCTGGCCACATTCATCAACTGCGGCAGGTTCAGCGACATCAAGAACGTGGACCCCA
AGAGCTTCAAGCTGGTGCAGAACAAGTACCTGGGCGTGATCATTCAGTGCCTGGTGACCGA
GACCAAGACAAGCGTGTCCAGGCACATCTACTTTTTCAGCGCCAGAGGCAGGATCGACCCC
CTGGTGTACCTGGACGAGTTCCTGAGGAACAGCGAGCCCGTGCTGAAGAGAGTGAACAGGA
CCGGCAACAGCAGCAGCAACAAGCAGGAGTACCAGCTGCTGAAGGACAACCTGGTGCGCAG
CTACAACAAGGCCCTGAAGAAGAACGCCCCCTACCCCATCTTCGCTATCAAGAACGGCCCTA
AGAGCCACATCGGCAGGCACCTGATGACCAGCTTTCTGAGCATGAAGGGCCTGACCGAGCT

| Fig 26 cont'd |
| --- |
| Vector ID (length between ITRs) & Sequence Between ITRs |
| GACAAACGTGGTGGGCAACTGGAGCGACAAGAGGGCCTCCGCCGTGGCCAGGACCACCTA CACCCACCAGATCACCGCCATCCCCGACCACTACTTCGCCCTGGTGTCCAGGTACTACGCCT ACGACCCCATCAGCAAGGAGATGATCGCCCTGAAGGACGAGACCAACCCCATCGAGGAGTG GCAGCACATCGAGCAGCTGAAGGGCAGCGCCGAGGGCAGCATCAGATACCCCGCCTGGAA CGGCATCATCAGCCAGGAGGTGCTGGACTACCTGAGCAGCTACATCAACAGGCGGATCTGA GAATTCGATATCAAGCTTATCGATAATCAACCTCTGGATTACAAAATTTGTGAAAGATTGACTG GTATTCTTAACTATGTTGCTCCTTTTACGCTATGTGGATACGCTGCTTTAATGCCTTTGTATCA TGCTATTGCTTCCCGTATGGCTTTCATTTTCTCCTCCTTGTATAAATCCTGGTTGCTGTCTCTT TATGAGGAGTTGTGGCCCGTTGTCAGGCAACGTGGCGTGGTGTGCACTGTGTTTGCTGACG CAACCCCCACTGGTTGGGGCATTGCCACCACCTGTCAGCTCCTTTCCGGGACTTTCGCTTTC CCCCTCCCTATTGCCACGGCGGAACTCATCGCCGCCTGCCTTGCCCGCTGCTGGACAGGGG CTCGGCTGTTGGGCACTGACAATTCCGTGGTGTTGTCGGGGAAATCATCGTCCTTTCCTTGG CTGCTCGCCTATGTTGCCACCTGGATTCTGCGCGGGACGTCCTTCTGCTACGTCCCTTCGGC CCTCAATCCAGCGGACCTTCCTTCCCGCGGCCTGCTGCCGGCTCTGCGGCCTCTTCCGCGT CTTCGCCTTCGCCCTCAGACGAGTCGGATCTCCCTTTGGGCCGCCTCCCCGCATCGATACC GAGCGCTGCTCGAGAGATCTACGGGTGGCATCCCTGTGACCCCTCCCCAGTGCCTCTCCTG GCCCTGGAAGTTGCCACTCCAGTGCCCACCAGCCTTGTCCTAATAAAATTAAGTTGCATCATT TTGTCTGACTAGGTGTCCTTCTATAATATTATGGGGTGGAGGGGGGTGGTATGGAGCAAGGG GCAAGTTGGGAAGACAACCTGTAGGGCCTGCGGGGTCTATTGGGAACCAAGCTGGAGTGCA GTGGCACAATCTTGGCTCACTGCAATCTCCGCCTCCTGGGTTCAAGCGATTCTCCTGCCTCA GCCTCCCGAGTTGTTGGGATTCCAGGCATGCATGACCAGGCTCAGCTAATTTTTGTTTTTTTG GTAGAGACGGGGTTTCACCATATTGGCCAGGCTGGTCTCCAACTCCTAATCTCAGGTGATCT ACCCACCTTGGCCTCCCAAATTGCTGGGATTACAGGCGTGAACCACTGCTCCCTTCCCTGTC CTTCTGATTTTGTAGGTAACCACGTGCGGACCGAGCGGCCGC (SEQ ID NO: 286) |
| 3005 (3537) GCGGCCGCACGCGTTGCCTGTGAGTATGTCTGTGGGGTACTCTCTTAATTAAGTTAATTGAT GTGAGAAGACCCAGGCCAGTATAGGGAGCACCATTCCCTAGGCAGGGGGCGGGTTATGAAA CAAATGAGTAGGGGAAATTGAGCTGAGCACAAGTAGCCTGCATACATGCAGTTAGTTCTCTC TGTTCTTGTCTGTGGATGTGATGCGACCAGCTGCCTCAAGCTCTCACCCTTGTAGGTTCCCTA CACTGATAGACTGTAACCTGGAATTGTGAGCTAAATGCAGCCATTTTCCTTTCAAATTGTTTTT TAGCCAGAGTAATTTTACGACAGCCATAGAAACCAAACTAGGGCAGGCCCCTAAACACAGCA TTTTTAACAAGAGCCCAGGCACTGCTCTTTCTGCTGAGCCTTGGTTTTGGAAAGAAAGGTCAA GAGCCTTTTATGAATGCAGGATGCACCTCTCTTATGCTTCCTCCCCTTGCCCCGTCTCCAAGG CATCCATTGAGTGCCTGTGTGCATGAGGCTGGGCTCCAACTTGTAGCAAAGAAACAAGACAC TTGGCATTCAAAGGGGACTCGGTGTGGACCCAACCTTGGAGCTCTCCCTTCTTCTTTTATTTT TTGGCTAAGAGCAAAATGAACCACAGCATCCAGTTCCTGGGGCGCACAACCATGGCCTTACT TTTCAGGGAAACAAACCCCCAAACACTTGGAGAGAAGCTGGCTTTAGGGCTGTGCCTGTGGC TGTAAATCGCCTTTGAACATTGTGGAACATCTTGGGCCTTTCCTTCAGAAGTCTTTCGAAATT GTTGACGTCCCTGCTGTCTGTAAAGAGACAAACTGCTCTTTCATCTGAGCTCACTTGGCATTG GGACATGGCCTGTCTGTCCCCTTGGCTTGTTGTTTCTAACCTCTTCCTTTCTATCCTGTCTTA GTCTGGAGCCCTGTCGCTCTGCATTCAATGGTGGGCATTGTCACACGAGTGAATCTCACTTA GCCCAAGAGAGCTCGGGCTGGGCATAAAGTCAGGGCAGAGCCATCTATTGCTTACATTTGC TTCTGGCGTGGCCACCATGGCTCCTAAGAAGAAGAGGAAGGTGATGAGCCAGTTCGACATC CTGTGCAAGACCCCCCCCAAGGTGCTGGTGCGGCAGTTCGTGGAGAGATTCGAGAGGCCCA GCGGCGAGAAGATCGCCAGCTGTGCCGCCGAGCTGACCTACCTGTGCTGGATGATCACCCA CAACGGCACCGCCATCAAGAGGGCCACCTTCATGAGCTACAACACCATCATCAGCAACAGCC TGAGCTTCGACATCGTGAACAAGAGCCTGCAGTTCAAGTACAAGACCCAGAAGGCCACCATC CTGGAGGCCAGCCTGAAGAAGCTGATCCCCGCCTGGGAGTTCACCATCATCCCTTACAACG GCCAGAAGCACCAGAGCGACATCACCGACATCGTGTCCAGCCTGCAGCTGCAGTTCGAGAG |

| Fig 26 cont'd |
| Vector ID (length between ITRs) & Sequence Between ITRs |

CAGCGAGGAGGCCGACAAGGGCAACAGCCACAGCAAGAAGATGCTGAAGGCCCTGCTGTC
CGAGGGCGAGAGCATCTGGGAGATCACCGAGAAGATCCTGAACAGCTTCGAGTACACCAGC
AGGTTCACCAAGACCAAGACCCTGTACCAGTTCCTGTTCCTGGCCACATTCATCAACTGCGG
CAGGTTCAGCGACATCAAGAACGTGGACCCCAAGAGCTTCAAGCTGGTGCAGAACAAGTAC
CTGGGCGTGATCATTCAGTGCCTGGTGACCGAGACCAAGACAAGCGTGTCCAGGCACATCT
ACTTTTTCAGCGCCAGAGGCAGGATCGACCCCCTGGTGTACCTGGACGAGTTCCTGAGGAA
CAGCGAGCCCGTGCTGAAGAGAGTGAACAGGACCGGCAACAGCAGCAGCAACAAGCAGGA
GTACCAGCTGCTGAAGGACAACCTGGTGCGCAGCTACAACAAGGCCCTGAAGAAGAACGCC
CCCTACCCCATCTTCGCTATCAAGAACGGCCCTAAGAGCCACATCGGCAGGCACCTGATGAC
CAGCTTTCTGAGCATGAAGGGCCTGACCGAGCTGACAAACGTGGTGGGCAACTGGAGCGAC
AAGAGGGCCTCCGCCGTGGCCAGGACCACCTACACCCACCAGATCACCGCCATCCCCGACC
ACTACTTCGCCCTGGTGTCCAGGTACTACGCCTACGACCCCATCAGCAAGGAGATGATCGCC
CTGAAGGACGAGACCAACCCCATCGAGGAGTGGCAGCACATCGAGCAGCTGAAGGGCAGC
GCCGAGGGCAGCATCAGATACCCCGCCTGGAACGGCATCATCAGCCAGGAGGTGCTGGACT
ACCTGAGCAGCTACATCAACAGGCGGATCTGAGAATTCGATATCAAGCTTATCGATAATCAAC
CTCTGGATTACAAAATTTGTGAAAGATTGACTGGTATTCTTAACTATGTTGCTCCTTTTACGCT
ATGTGGATACGCTGCTTTAATGCCTTTGTATCATGCTATTGCTTCCCGTATGGCTTTCATTTTC
TCCTCCTTGTATAAATCCTGGTTGCTGTCTCTTTATGAGGAGTTGTGGCCCGTTGTCAGGCAA
CGTGGCGTGGTGTGCACTGTGTTTGCTGACGCAACCCCCACTGGTTGGGGCATTGCCACCA
CCTGTCAGCTCCTTTCCGGGACTTTCGCTTTCCCCCTCCCTATTGCCACGGCGGAACTCATC
GCCGCCTGCCTTGCCCGCTGCTGGACAGGGGCTCGGCTGTTGGGCACTGACAATTCCGTGG
TGTTGTCGGGGAAATCATCGTCCTTTCCTTGGCTGCTCGCCTATGTTGCCACCTGGATTCTG
CGCGGGACGTCCTTCTGCTACGTCCCTTCGGCCCTCAATCCAGCGGACCTTCCTTCCCGCG
GCCTGCTGCCGGCTCTGCGGCCTCTTCCGCGTCTTCGCCTTCGCCCTCAGACGAGTCGGAT
CTCCCTTTGGGCCGCCTCCCCGCATCGATACCGAGCGCTGCTCGAGAGATCTACGGGTGGC
ATCCCTGTGACCCCTCCCCAGTGCCTCTCCTGGCCCTGGAAGTTGCCACTCCAGTGCCCAC
CAGCCTTGTCCTAATAAAATTAAGTTGCATCATTTTGTCTGACTAGGTGTCCTTCTATAATATT
ATGGGGTGGAGGGGGGTGGTATGGAGCAAGGGGCAAGTTGGGAAGACAACCTGTAGGGCC
TGCGGGGTCTATTGGGAACCAAGCTGGAGTGCAGTGGCACAATCTTGGCTCACTGCAATCTC
CGCCTCCTGGGTTCAAGCGATTCTCCTGCCTCAGCCTCCCGAGTTGTTGGGATTCCAGGCAT
GCATGACCAGGCTCAGCTAATTTTTGTTTTTTTGGTAGAGACGGGGTTTCACCATATTGGCCA
GGCTGGTCTCCAACTCCTAATCTCAGGTGATCTACCCACCTTGGCCTCCCAAATTGCTGGGA
TTACAGGCGTGAACCACTGCTCCCTTCCCTGTCCTTCTGATTTTGTAGGTAACCACGTGCGG
ACCGAGCGGCCGC (SEQ ID NO: 287)

3006 (3660)
GCGGCCGCACGCGTGACTCATTCATTTCTCTCTTATCTTCAATGTTAGGGACTGATTCAAAAC
AGCATAATCAAAACAAAGCAGAGCACAGCATAATTAAAATCATGTCTTCTGAATAGGTAATTAC
AAAACTAATTGGATATTGGTAATTATTTTCTTTTTACCTGTTCCTGGCTCCTTTCTCAGTTAATA
TGTAGTGCTATGTACAGATGAAGTTCAGATGCAATTATGTACAGGGTCTATCTCACCACCAGG
AAGCAGGACTTTTCTGTGTGATCTTCCATTTCCTGCAAGGACTACAGAATTGAGGTACAAGTG
CCTTTTGTTTTCCTCAAGTTGAGTCCTTCTGTTTTCTTTGTCACTGGCTTTCATCCTCTGTCCC
ACTGGCTGTGGCTCAGTGTTTATTTATTGGCTGTTTAGTATGGAGAAACATCCAGTCTTTCAA
CATTGACAACAAATCCAAATAATGAGCCTGCCCATCACGCTACACTGGGTATCATCTTTGCCT
GTTAGGCTCTTGGCTGGTTTTTTGCTGTATTTGACTATCCTCAAAGTTTGGGAGTTCTGACTG
CGGGTTGTTATTTTCCAATTCTTATTAACACTTGCCAAATCTTTTGTCATGCATCTTTATACTCA
TGACAGCTTCTAGGTCAAATTTTAGTTTTGATCACTGGATCTTTAGAAGGAAAGCTAAGGAAC
TGACAGACATAGCCAGCTCCTTTTTTTATGCTGGCAATGGATACTGATTAGCTGTGTGCTAGT
TGTTGAAGTCATAGCAACAAGTCCTACTTACTATCTTTTAGGCATCTCAATTAAGTTTCTTTGG
TCTTTGGAAATATAACTACAATTAAGTTTCATCTCCTGGAGAAAATGAGTATGTTCAGGAGAAC

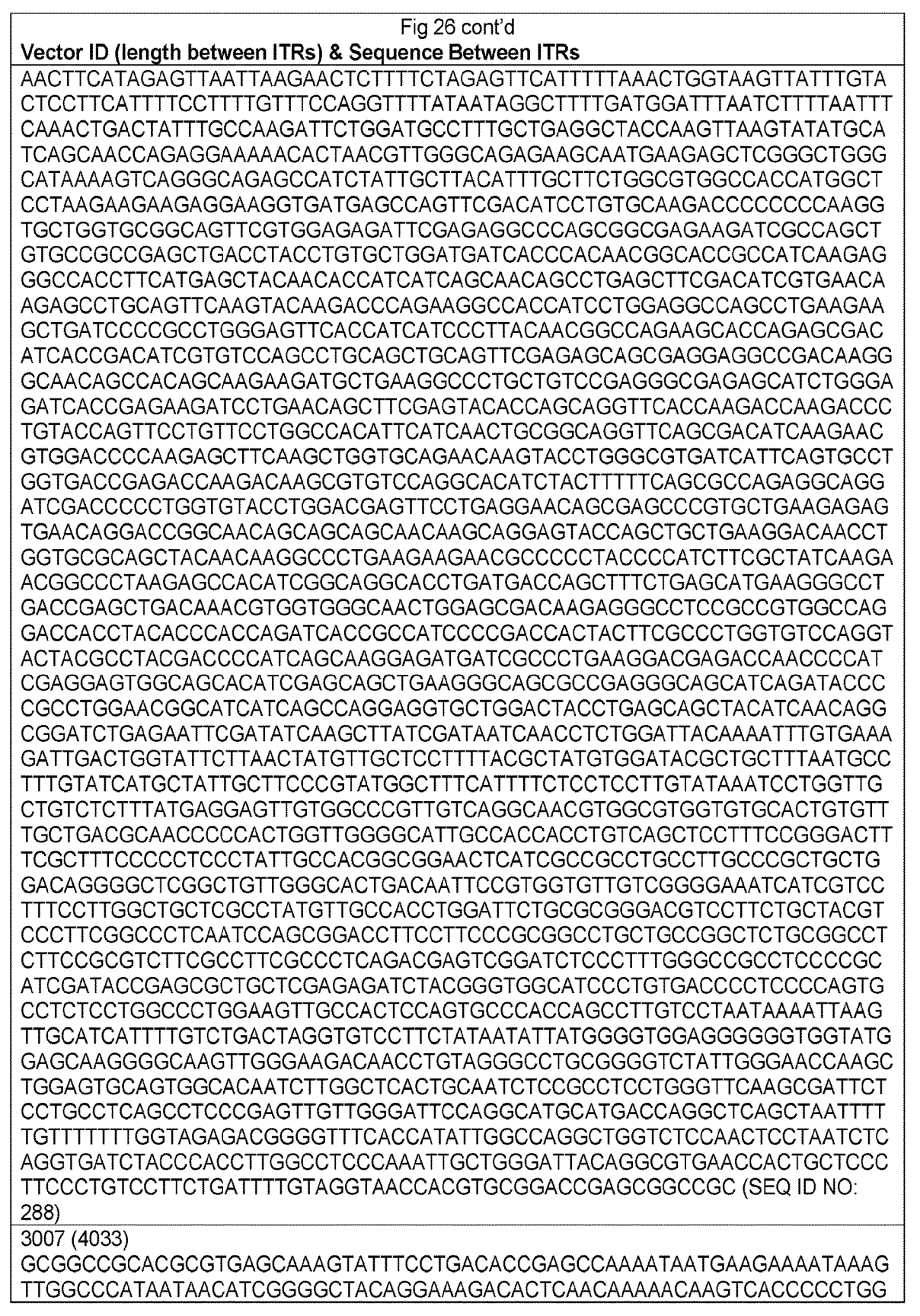

| Fig 26 cont'd |
| Vector ID (length between ITRs) & Sequence Between ITRs |

AACTTCATAGAGTTAATTAAGAACTCTTTTCTAGAGTTCATTTTTAAACTGGTAAGTTATTTGTA
CTCCTTCATTTTCCTTTTGTTTCCAGGTTTTATAATAGGCTTTTGATGGATTTAATCTTTTAATTT
CAAACTGACTATTTGCCAAGATTCTGGATGCCTTTGCTGAGGCTACCAAGTTAAGTATATGCA
TCAGCAACCAGAGGAAAAACACTAACGTTGGGCAGAGAAGCAATGAAGAGCTCGGGCTGGG
CATAAAAGTCAGGGCAGAGCCATCTATTGCTTACATTTGCTTCTGGCGTGGCCACCATGGCT
CCTAAGAAGAAGAGGAAGGTGATGAGCCAGTTCGACATCCTGTGCAAGACCCCCCCCAAGG
TGCTGGTGCGGCAGTTCGTGGAGAGATTCGAGAGGCCCAGCGGCGAGAAGATCGCCAGCT
GTGCCGCCGAGCTGACCTACCTGTGCTGGATGATCACCCACAACGGCACCGCCATCAAGAG
GGCCACCTTCATGAGCTACAACACCATCATCAGCAACAGCCTGAGCTTCGACATCGTGAACA
AGAGCCTGCAGTTCAAGTACAAGACCCAGAAGGCCACCATCCTGGAGGCCAGCCTGAAGAA
GCTGATCCCCGCCTGGGAGTTCACCATCATCCCTTACAACGGCCAGAAGCACCAGAGCGAC
ATCACCGACATCGTGTCCAGCCTGCAGCTGCAGTTCGAGAGCAGCGAGGAGGCCGACAAGG
GCAACAGCCACAGCAAGAAGATGCTGAAGGCCCTGCTGTCCGAGGGCGAGAGCATCTGGGA
GATCACCGAGAAGATCCTGAACAGCTTCGAGTACACCAGCAGGTTCACCAAGACCAAGACCC
TGTACCAGTTCCTGTTCCTGGCCACATTCATCAACTGCGGCAGGTTCAGCGACATCAAGAAC
GTGGACCCCAAGAGCTTCAAGCTGGTGCAGAACAAGTACCTGGGCGTGATCATTCAGTGCCT
GGTGACCGAGACCAAGACAAGCGTGTCCAGGCACATCTACTTTTTCAGCGCCAGAGGCAGG
ATCGACCCCCTGGTGTACCTGGACGAGTTCCTGAGGAACAGCGAGCCCGTGCTGAAGAGAG
TGAACAGGACCGGCAACAGCAGCAGCAACAAGCAGGAGTACCAGCTGCTGAAGGACAACCT
GGTGCGCAGCTACAACAAGGCCCTGAAGAAGAACGCCCCCTACCCCATCTTCGCTATCAAGA
ACGGCCCTAAGAGCCACATCGGCAGGCACCTGATGACCAGCTTTCTGAGCATGAAGGGCCT
GACCGAGCTGACAAACGTGGTGGGCAACTGGAGCGACAAGAGGGCCTCCGCCGTGGCCAG
GACCACCTACACCCACCAGATCACCGCCATCCCCGACCACTACTTCGCCCTGGTGTCCAGGT
ACTACGCCTACGACCCCATCAGCAAGGAGATGATCGCCCTGAAGGACGAGACCAACCCCAT
CGAGGAGTGGCAGCACATCGAGCAGCTGAAGGGCAGCGCCGAGGGCAGCATCAGATACCC
CGCCTGGAACGGCATCATCAGCCAGGAGGTGCTGGACTACCTGAGCAGCTACATCAACAGG
CGGATCTGAGAATTCGATATCAAGCTTATCGATAATCAACCTCTGGATTACAAAATTTGTGAAA
GATTGACTGGTATTCTTAACTATGTTGCTCCTTTTACGCTATGTGGATACGCTGCTTTAATGCC
TTTGTATCATGCTATTGCTTCCCGTATGGCTTTCATTTTCTCCTCCTTGTATAAATCCTGGTTG
CTGTCTCTTTATGAGGAGTTGTGGCCCGTTGTCAGGCAACGTGGCGTGGTGTGCACTGTGTT
TGCTGACGCAACCCCCACTGGTTGGGGCATTGCCACCACCTGTCAGCTCCTTTCCGGGACTT
TCGCTTTCCCCCTCCCTATTGCCACGGCGGAACTCATCGCCGCCTGCCTTGCCCGCTGCTG
GACAGGGGCTCGGCTGTTGGGCACTGACAATTCCGTGGTGTTGTCGGGGAAATCATCGTCC
TTTCCTTGGCTGCTCGCCTATGTTGCCACCTGGATTCTGCGCGGGACGTCCTTCTGCTACGT
CCCTTCGGCCCTCAATCCAGCGGACCTTCCTTCCCGCGGCCTGCTGCCGGCTCTGCGGCCT
CTTCCGCGTCTTCGCCTTCGCCCTCAGACGAGTCGGATCTCCCTTTGGGCCGCCTCCCCGC
ATCGATACCGAGCGCTGCTCGAGAGATCTACGGGTGGCATCCCTGTGACCCCTCCCCAGTG
CCTCTCCTGGCCCTGGAAGTTGCCACTCCAGTGCCCACCAGCCTTGTCCTAATAAAATTAAG
TTGCATCATTTTGTCTGACTAGGTGTCCTTCTATAATATTATGGGGTGGAGGGGGGTGGTATG
GAGCAAGGGGCAAGTTGGGAAGACAACCTGTAGGGCCTGCGGGGTCTATTGGGAACCAAGC
TGGAGTGCAGTGGCACAATCTTGGCTCACTGCAATCTCCGCCTCCTGGGTTCAAGCGATTCT
CCTGCCTCAGCCTCCCGAGTTGTTGGGATTCCAGGCATGCATGACCAGGCTCAGCTAATTTT
TGTTTTTTTGGTAGAGACGGGGTTTCACCATATTGGCCAGGCTGGTCTCCAACTCCTAATCTC
AGGTGATCTACCCACCTTGGCCTCCCAAATTGCTGGGATTACAGGCGTGAACCACTGCTCCC
TTCCCTGTCCTTCTGATTTTGTAGGTAACCACGTGCGGACCGAGCGGCCGC (SEQ ID NO: 288)

| 3007 (4033) |
| GCGGCCGCACGCGTGAGCAAAGTATTTCCTGACACCGAGCCAAAATAATGAAGAAAATAAAG |
| TTGGCCCATAATAACATCGGGGCTACAGGAAAGACACTCAACAAAAACAAGTCACCCCCTGG |

| Fig 26 cont'd |
| --- |
| Vector ID (length between ITRs) & Sequence Between ITRs |
| TACTCCTCAAACTTTGTTTTAATTTCCCACAGTGGCACAGAAAGTCTCCTGGCCACAAGTTAC |
| CTATCATCTTAATTTCTGCTTCTTAGAGGGTTTGTGTTTGGTTTTTGTCCTTAATGAGACATATT |
| TGCCAAAGAGGCTTTCAAAAGGCATTTTTTGCTCTTGCGGAAGAGTAATTAGGTCGGTACCTC |
| TTTCCCTGCCAGCATCAGCTGCCTAAAGAGAATCCTGCCTAGTATTTAATGCCCAAACAGAAG |
| AAGCATCATTTCCACTAATTGGTCCTGAAGTTCCGATGTTCCCAAAGGGTCTTTTTATTTTGCA |
| AGGATCAGAAAGGACACACGTAAAATGTGATAGCGTCACCAGTGACCTTCATCGCTCTCATC |
| TGCACTATTACCGTCATCCTTTCTTATATTTTTTTCCCCCCAGTGGACGGGAACACAATGCCA |
| ACTGAGGGAGTGAGGAAGGCTTTTGCAAGTTTACTGCTGATGGCATCTCTGGGCCAAGTTCA |
| AAGGTCACAGCAGAAATGCTTATAAATGAGAGAAAAAGCACAAATGCATAAAATATACAAGAG |
| TTTGATTTCTTTGATGGGTCCATTTTAGGGACAGTGTTAAGTACTCGGGGGAAAACGTTACTG |
| TTGGAAGATGAGGATGCAGACGCAAGGGAAATACGGGACGATTCATCAAGTGAACTGGAAAT |
| ATAGTATATACTGCTAACTGTTTTTGTTTTTGTTTCTGTTTTTGTTTTTGTTTTTCCTTTCCACAG |
| CCTAAGAGGAGTTTTGGAGTATCATATCACGCACTCTTATGACGAGAAGGGAAACAGATGATA |
| GGAATGGGGGGATGGGCATGTAGCAGAATATTTACACAAACTTCTCGTCATTGAAAGCTCTGG |
| AAATGGCCTTATTAACTCTCAGGAAGTTTCCAATTCTTTAACGTAATGATCAGGCTACACGGAT |
| GCCCTTAGAAACATGGCCAAGCAATCATTAGGCAGAGCTTCAGCCATCCCCATTCAGATGGG |
| CCAAAGAAACCAGACTGGAAGAACAGACTGCCTGCTCTGTCTTCTGGGTTAAGTTCCCTTTTT |
| TTTGCTTATTCTTCTTTTTTTGACTTGTACCTTGAAAATGAAGCTCAAAGCCCTATCATTTCACT |
| ATGTTTTATCCAAGTGACAGGCAGGCTCTGGCTGTGGCCTTCTTCTCTCTTTAAAGAGCCACT |
| TTTCACTGCAGAAGCCCAGTGTCAAAAGGCTTGAGGTGAATAAAGAGGAGGAGAGTGTTAAA |
| GAGACCCTTTCAAAACCAAAATTGTATGTTCCCATGAGCATGGTTTTCTGTGCCACTGAAAGA |
| TTGGCTATGCAGAAACGAGCCTGCTTGCCAGTGTCTATACTGTCTGCTTACTTTGAGCTCGG |
| GCTGGGCATAAAAGTCAGGGCAGAGCCATCTATTGCTTACATTTGCTTCTGGCGTGGCCACC |
| ATGGCTCCTAAGAAGAAGAGGAAGGTGATGAGCCAGTTCGACATCCTGTGCAAGACCCCCC |
| CCAAGGTGCTGGTGCGGCAGTTCGTGGAGAGATTCGAGAGGCCCAGCGGCGAGAAGATCG |
| CCAGCTGTGCCGCCGAGCTGACCTACCTGTGCTGGATGATCACCCACAACGGCACCGCCAT |
| CAAGAGGGCCACCTTCATGAGCTACAACACCATCATCAGCAACAGCCTGAGCTTCGACATCG |
| TGAACAAGAGCCTGCAGTTCAAGTACAAGACCCAGAAGGCCACCATCCTGGAGGCCAGCCT |
| GAAGAAGCTGATCCCCGCCTGGGAGTTCACCATCATCCCTTACAACGGCCAGAAGCACCAG |
| AGCGACATCACCGACATCGTGTCCAGCCTGCAGCTGCAGTTCGAGAGCAGCGAGGAGGCCG |
| ACAAGGGCAACAGCCACAGCAAGAAGATGCTGAAGGCCCTGCTGTCCGAGGGCGAGAGCAT |
| CTGGGAGATCACCGAGAAGATCCTGAACAGCTTCGAGTACACCAGCAGGTTCACCAAGACCA |
| AGACCCTGTACCAGTTCCTGTTCCTGGCCACATTCATCAACTGCGGCAGGTTCAGCGACATC |
| AAGAACGTGGACCCCAAGAGCTTCAAGCTGGTGCAGAACAAGTACCTGGGCGTGATCATTCA |
| GTGCCTGGTGACCGAGACCAAGACAAGCGTGTCCAGGCACATCTACTTTTTCAGCGCCAGA |
| GGCAGGATCGACCCCCTGGTGTACCTGGACGAGTTCCTGAGGAACAGCGAGCCCGTGCTGA |
| AGAGAGTGAACAGGACCGGCAACAGCAGCAGCAACAAGCAGGAGTACCAGCTGCTGAAGGA |
| CAACCTGGTGCGCAGCTACAACAAGGCCCTGAAGAAGAACGCCCCCTACCCCATCTTCGCTA |
| TCAAGAACGGCCCTAAGAGCCACATCGGCAGGCACCTGATGACCAGCTTTCTGAGCATGAA |
| GGGCCTGACCGAGCTGACAAACGTGGTGGGCAACTGGAGCGACAAGAGGGCCTCCGCCGT |
| GGCCAGGACCACCTACACCCACCAGATCACCGCCATCCCCGACCACTACTTCGCCCTGGTG |
| TCCAGGTACTACGCCTACGACCCCATCAGCAAGGAGATGATCGCCCTGAAGGACGAGACCA |
| ACCCCATCGAGGAGTGGCAGCACATCGAGCAGCTGAAGGGCAGCGCCGAGGGCAGCATCA |
| GATACCCCGCCTGGAACGGCATCATCAGCCAGGAGGTGCTGGACTACCTGAGCAGCTACAT |
| CAACAGGCGGATCTGAGAATTCGATATCAAGCTTATCGATAATCAACCTCTGGATTACAAAAT |
| TTGTGAAAGATTGACTGGTATTCTTAACTATGTTGCTCCTTTTACGCTATGTGGATACGCTGCT |
| TTAATGCCTTTGTATCATGCTATTGCTTCCCGTATGGCTTTCATTTTCTCCTCCTTGTATAAATC |
| CTGGTTGCTGTCTCTTTATGAGGAGTTGTGGCCCGTTGTCAGGCAACGTGGCGTGGTGTGCA |
| CTGTGTTTGCTGACGCAACCCCCACTGGTTGGGGCATTGCCACCACCTGTCAGCTCCTTTCC |

| Fig 26 cont'd |
|---|
| Vector ID (length between ITRs) & Sequence Between ITRs |
| GGGACTTTCGCTTTCCCCCTCCCTATTGCCACGGCGGAACTCATCGCCGCCTGCCTTGCCC GCTGCTGGACAGGGGCTCGGCTGTTGGGCACTGACAATTCCGTGGTGTTGTCGGGGAAATC ATCGTCCTTTCCTTGGCTGCTCGCCTATGTTGCCACCTGGATTCTGCGCGGGACGTCCTTCT GCTACGTCCCTTCGGCCCTCAATCCAGCGGACCTTCCTTCCCGCGGCCTGCTGCCGGCTCT GCGGCCTCTTCCGCGTCTTCGCCTTCGCCCTCAGACGAGTCGGATCTCCCTTTGGGCCGCC TCCCCGCATCGATACCGAGCGCTGCTCGAGAGATCTACGGGTGGCATCCCTGTGACCCCTC CCCAGTGCCTCTCCTGGCCCTGGAAGTTGCCACTCCAGTGCCCACCAGCCTTGTCCTAATAA AATTAAGTTGCATCATTTTGTCTGACTAGGTGTCCTTCTATAATATTATGGGGTGGAGGGGGG TGGTATGGAGCAAGGGGCAAGTTGGGAAGACAACCTGTAGGGCCTGCGGGGTCTATTGGGA ACCAAGCTGGAGTGCAGTGGCACAATCTTGGCTCACTGCAATCTCCGCCTCCTGGGTTCAAG CGATTCTCCTGCCTCAGCCTCCCGAGTTGTTGGGATTCCAGGCATGCATGACCAGGCTCAGC TAATTTTTGTTTTTTTGGTAGAGACGGGGTTTCACCATATTGGCCAGGCTGGTCTCCAACTCC TAATCTCAGGTGATCTACCCACCTTGGCCTCCCAAATTGCTGGGATTACAGGCGTGAACCAC TGCTCCCTTCCCTGTCCTTCTGATTTTGTAGGTAACCACGTGCGGACCGAGCGGCCGC (SEQ ID NO: 289) |
| 3008 (3328) GCGGCCGCACGCGTATGCAGGCACCCTGGCTGATTCAGACACTGGACAGGAAGCACTACTG CCTGCCGTTTCTTGGGAAGCGACTTCCAGTCTCCAAACATTTTCCTCTGCTGTGCAATGGGC ATCCACACACTTAGCCTCCTGTCCTGCCCCGTAGGGTTGAGCATCCTCAGACTTGGACCCTG TGGGATCTGCAGCCAGGTGCAGAGGCTGTGCACACCTGTAACTTCAGTACTTGGGGTGTGG AGACAAGAGGAGCAGGAGCTGAAGGTCATCCTTGGCTAAACAGAGTTCAAAGTCATCCTAAG CTATGTGAGACACTCATACAGGAATACATTCTTAAAAGGAACTTTTGTTAGCCCCACCTGCAG GAAGTAAGTTTGTGCCAAAGCCCTGGGCCCCTTACCTATGCAAGTTCCTGTTAGGTTACACC ATCCCCCACTGAGATCTAAGCCTTGGAAACCCCAGGAAACAACTGAATGTCCAGTCCTTTGT GCCCTTCCTGATGAGAGAGCCTCTCTCCCCACCTACTGACACTTAGCAAAGGCTCCATCACG GCCCCACCTCTGGTTAAAGGAGGAAGCTGGGTCTGGGTCGGAAAGTCCCGCCCAGGTGTGA AGCAAGCCCTTCCTCTGCCCACACCCTTCACCATGCCCAGAAGATAAAGTACACAGGATGAG GGCCAGCTCATACACAGCCCTGCAGTCCTGTGCGGCACGTCCAGCATGTTGTTTGCCTGTG CTCTCCTTGCCCTCCTGGGTCTGGCAACCTCCTGCAGTTTCATCGTGCCCCGCAGTGAGAGC TCGGGCTGGGCATAAAAGTCAGGGCAGAGCCATCTATTGCTTACATTTGCTTCTGGCGTGGC CACCATGGCTCCTAAGAAGAAGAGGAAGGTGATGAGCCAGTTCGACATCCTGTGCAAGACC CCCCCCAAGGTGCTGGTGCGGCAGTTCGTGGAGAGATTCGAGAGGCCCAGCGGCGAGAAG ATCGCCAGCTGTGCCGCCGAGCTGACCTACCTGTGCTGGATGATCACCCACAACGGCACCG CCATCAAGAGGGCCACCTTCATGAGCTACAACACCATCATCAGCAACAGCCTGAGCTTCGAC ATCGTGAACAAGAGCCTGCAGTTCAAGTACAAGACCCAGAAGGCCACCATCCTGGAGGCCA GCCTGAAGAAGCTGATCCCCGCCTGGGAGTTCACCATCATCCCTTACAACGGCCAGAAGCA CCAGAGCGACATCACCGACATCGTGTCCAGCCTGCAGCTGCAGTTCGAGAGCAGCGAGGAG GCCGACAAGGGCAACAGCCACAGCAAGAAGATGCTGAAGGCCCTGCTGTCCGAGGGCGAG AGCATCTGGGAGATCACCGAGAAGATCCTGAACAGCTTCGAGTACACCAGCAGGTTCACCAA GACCAAGACCCTGTACCAGTTCCTGTTCCTGGCCACATTCATCAACTGCGGCAGGTTCAGCG ACATCAAGAACGTGGACCCCAAGAGCTTCAAGCTGGTGCAGAACAAGTACCTGGGCGTGAT CATTCAGTGCCTGGTGACCGAGACCAAGACAAGCGTGTCCAGGCACATCTACTTTTTCAGCG CCAGAGGCAGGATCGACCCCCTGGTGTACCTGGACGAGTTCCTGAGGAACAGCGAGCCCGT GCTGAAGAGAGTGAACAGGACCGGCAACAGCAGCAGCAACAAGCAGGAGTACCAGCTGCTG AAGGACAACCTGGTGCGCAGCTACAACAAGGCCCTGAAGAAGAACGCCCCCTACCCCATCT TCGCTATCAAGAACGGCCCTAAGAGCCACATCGGCAGGCACCTGATGACCAGCTTTCTGAGC ATGAAGGGCCTGACCGAGCTGACAAACGTGGTGGGCAACTGGAGCGACAAGAGGGCCTCC GCCGTGGCCAGGACCACCTACACCCACCAGATCACCGCCATCCCCGACCACTACTTCGCCC TGGTGTCCAGGTACTACGCCTACGACCCCATCAGCAAGGAGATGATCGCCCTGAAGGACGA |

| Fig 26 cont'd |
|---|
| Vector ID (length between ITRs) & Sequence Between ITRs |
| GACCAACCCCATCGAGGAGTGGCAGCACATCGAGCAGCTGAAGGGCAGCGCCGAGGGCAG CATCAGATACCCCGCCTGGAACGGCATCATCAGCCAGGAGGTGCTGGACTACCTGAGCAGC TACATCAACAGGCGGATCTGAGAATTCGATATCAAGCTTATCGATAATCAACCTCTGGATTAC AAAATTTGTGAAAGATTGACTGGTATTCTTAACTATGTTGCTCCTTTTACGCTATGTGGATACG CTGCTTTAATGCCTTTGTATCATGCTATTGCTTCCCGTATGGCTTTCATTTTCTCCTCCTTGTA TAAATCCTGGTTGCTGTCTCTTTATGAGGAGTTGTGGCCCGTTGTCAGGCAACGTGGCGTGG TGTGCACTGTGTTTGCTGACGCAACCCCCACTGGTTGGGGCATTGCCACCACCTGTCAGCTC CTTTCCGGGACTTTCGCTTTCCCCCTCCCTATTGCCACGGCGGAACTCATCGCCGCCTGCCT TGCCCGCTGCTGGACAGGGGCTCGGCTGTTGGGCACTGACAATTCCGTGGTGTTGTCGGGG AAATCATCGTCCTTTCCTTGGCTGCTCGCCTATGTTGCCACCTGGATTCTGCGCGGGACGTC CTTCTGCTACGTCCCTTCGGCCCTCAATCCAGCGGACCTTCCTTCCCGCGGCCTGCTGCCG GCTCTGCGGCCTCTTCCGCGTCTTCGCCTTCGCCCTCAGACGAGTCGGATCTCCCTTTGGG CCGCCTCCCCGCATCGATACCGAGCGCTGCTCGAGAGATCTACGGGTGGCATCCCTGTGAC CCCTCCCCAGTGCCTCTCCTGGCCCTGGAAGTTGCCACTCCAGTGCCCACCAGCCTTGTCCT AATAAAATTAAGTTGCATCATTTTGTCTGACTAGGTGTCCTTCTATAATATTATGGGGTGGAGG GGGGTGGTATGGAGCAAGGGGCAAGTTGGGAAGACAACCTGTAGGGCCTGCGGGGTCTATT GGGAACCAAGCTGGAGTGCAGTGGCACAATCTTGGCTCACTGCAATCTCCGCCTCCTGGGT TCAAGCGATTCTCCTGCCTCAGCCTCCCGAGTTGTTGGGATTCCAGGCATGCATGACCAGGC TCAGCTAATTTTTGTTTTTTGGTAGAGACGGGGTTTCACCATATTGGCCAGGCTGGTCTCCA ACTCCTAATCTCAGGTGATCTACCCACCTTGGCCTCCCAAATTGCTGGGATTACAGGCGTGA ACCACTGCTCCCTTCCCTGTCCTTCTGATTTTGTAGGTAACCACGTGCGGACCGAGCGGCCG C (SEQ ID NO: 290) |
| 3009 (3109) GCGGCCGCACGCGTGTGCTGCAGCTTCTGTTCACAGATAGAAACCATCATTTTGTTGTCCAC GGTCTCTGAAGAGCAACTGACAGAGGAGGCTGGTGGTACTTGAGGAGAGCAGCCTGTGGCT CCGCCTTTTCCTTCCTGGAGCACTGCTAGCTCTTTCCTGAAGCCTCTGCCTGGCCCACAGAG CAGACGTCACAAGCCAGCTTCGCTAGTGAGTTATTACAGACAGGAAAACATCTAGAGACTGA TCAGACCCAAGGAACAGGCTGAGTCATACAGCAAGGATGCGACTTTTCTGAGAATGCCAAGA CTCACAGGATGTCTGGTGTTTTATAGATAACAATTGTTAGAGAACACAATTATGGCAGGATGA AGTCAGTGGGGAGAGCTACAGTGTCTCACAGCAGTACTTCAGATTCTGCATCTGTAGATAGA GCATCAAGCAGTGTGTACCTGTCGGTGTCTGTCTTGCTTAAAATACAGCCTAAGACTGACAGA AGCACCTTGAGAGGATGAAACAACCACTCATAAACAGAGAAGTCTGAAACACTTATCACTTCC CCTGAACATCAGTGTCTCAGGAGCTCGGGCTGGGCATAAAAGTCAGGGCAGAGCCATCTATT GCTTACATTTGCTTCTGGCGTGGCCACCATGGCTCCTAAGAAGAAGAGGAAGGTGATGAGCC AGTTCGACATCCTGTGCAAGACCCCCCCCAAGGTGCTGGTGCGGCAGTTCGTGGAGAGATT CGAGAGGCCCAGCGGCGAGAAGATCGCCAGCTGTGCCGCCGAGCTGACCTACCTGTGCTG GATGATCACCCACAACGGCACCGCCATCAAGAGGGCCACCTTCATGAGCTACAACACCATCA TCAGCAACAGCCTGAGCTTCGACATCGTGAACAAGAGCCTGCAGTTCAAGTACAAGACCCAG AAGGCCACCATCCTGGAGGCCAGCCTGAAGAAGCTGATCCCCGCCTGGGAGTTCACCATCA TCCCTTACAACGGCCAGAAGCACCAGAGCGACATCACCGACATCGTGTCCAGCCTGCAGCT GCAGTTCGAGAGCAGCGAGGAGGCCGACAAGGGCAACAGCCACAGCAAGAAGATGCTGAA GGCCCTGCTGTCCGAGGGCGAGAGCATCTGGGAGATCACCGAGAAGATCCTGAACAGCTTC GAGTACACCAGCAGGTTCACCAAGACCAAGACCCTGTACCAGTTCCTGTTCCTGGCCACATT CATCAACTGCGGCAGGTTCAGCGACATCAAGAACGTGGACCCCAAGAGCTTCAAGCTGGTG CAGAACAAGTACCTGGGCGTGATCATTCAGTGCCTGGTGACCGAGACCAAGACAAGCGTGT CCAGGCACATCTACTTTTTCAGCGCCAGAGGCAGGATCGACCCCCTGGTGTACCTGGACGA GTTCCTGAGGAACAGCGAGCCCGTGCTGAAGAGAGTGAACAGGACCGGCAACAGCAGCAG CAACAAGCAGGAGTACCAGCTGCTGAAGGACAACCTGGTGCGCAGCTACAACAAGGCCCTG AAGAAGAACGCCCCCTACCCCATCTTCGCTATCAAGAACGGCCCTAAGAGCCACATCGGCAG |

| Fig 26 cont'd |
|---|
| Vector ID (length between ITRs) & Sequence Between ITRs |
| GCACCTGATGACCAGCTTTCTGAGCATGAAGGGCCTGACCGAGCTGACAAACGTGGTGGGC<br>AACTGGAGCGACAAGAGGGCCTCCGCCGTGGCCAGGACCACCTACACCCACCAGATCACCG<br>CCATCCCCGACCACTACTTCGCCCTGGTGTCCAGGTACTACGCCTACGACCCCATCAGCAAG<br>GAGATGATCGCCCTGAAGGACGAGACCAACCCCATCGAGGAGTGGCAGCACATCGAGCAGC<br>TGAAGGGCAGCGCCGAGGGCAGCATCAGATACCCCGCCTGGAACGGCATCATCAGCCAGG<br>AGGTGCTGGACTACCTGAGCAGCTACATCAACAGGCGGATCTGAGAATTCGATATCAAGCTT<br>ATCGATAATCAACCTCTGGATTACAAAATTTGTGAAAGATTGACTGGTATTCTTAACTATGTTG<br>CTCCTTTTACGCTATGTGGATACGCTGCTTTAATGCCTTTGTATCATGCTATTGCTTCCCGTAT<br>GGCTTTCATTTTCTCCTCCTTGTATAAATCCTGGTTGCTGTCTCTTTATGAGGAGTTGTGGCC<br>CGTTGTCAGGCAACGTGGCGTGGTGTGCACTGTGTTTGCTGACGCAACCCCCACTGGTTGG<br>GGCATTGCCACCACCTGTCAGCTCCTTTCCGGGACTTTCGCTTTCCCCCTCCCTATTGCCAC<br>GGCGGAACTCATCGCCGCCTGCCTTGCCCGCTGCTGGACAGGGGCTCGGCTGTTGGGCAC<br>TGACAATTCCGTGGTGTTGTCGGGGAAATCATCGTCCTTTCCTTGGCTGCTCGCCTATGTTG<br>CCACCTGGATTCTGCGCGGGACGTCCTTCTGCTACGTCCCTTCGGCCCTCAATCCAGCGGA<br>CCTTCCTTCCCGCGGCCTGCTGCCGGCTCTGCGGCCTCTTCCGCGTCTTCGCCTTCGCCCT<br>CAGACGAGTCGGATCTCCCTTTGGGCCGCCTCCCCGCATCGATACCGAGCGCTGCTCGAGA<br>GATCTACGGGTGGCATCCCTGTGACCCCTCCCCAGTGCCTCTCCTGGCCCTGGAAGTTGCC<br>ACTCCAGTGCCCACCAGCCTTGTCCTAATAAAATTAAGTTGCATCATTTTGTCTGACTAGGTG<br>TCCTTCTATAATATTATGGGGTGGAGGGGGGTGGTATGGAGCAAGGGGCAAGTTGGGAAGA<br>CAACCTGTAGGGCCTGCGGGGTCTATTGGGAACCAAGCTGGAGTGCAGTGGCACAATCTTG<br>GCTCACTGCAATCTCCGCCTCCTGGGTTCAAGCGATTCTCCTGCCTCAGCCTCCCGAGTTGT<br>TGGGATTCCAGGCATGCATGACCAGGCTCAGCTAATTTTTGTTTTTTTGGTAGAGACGGGGTT<br>TCACCATATTGGCCAGGCTGGTCTCCAACTCCTAATCTCAGGTGATCTACCCACCTTGGCCT<br>CCCAAATTGCTGGGATTACAGGCGTGAACCACTGCTCCCTTCCCTGTCCTTCTGATTTTGTAG<br>GTAACCACGTGCGGACCGAGCGGCCGC (SEQ ID NO: 291) |
| 3010 (2974)<br>GCGGCCGCACGCGTAAGTGCTGCAGCTTCTGTTCACAGATAGAAACCAGAACTTTGTTGTCC<br>AGGGCCTCTGAAGAGCAACTGACAGAGGAGGCTAGTGGTGCATGAGGAGAGCAGCCTGTG<br>GCTCCACCTTTTCCTTCCTGGAGCACTGCTAGTTCTTTCCTGAAGCCTCGGCCTGGCCCACA<br>GAGCAGACGTCACAAGCCAGCTTCACAACTACAGACAGGAAAACATCTAGAGACTGACCAGA<br>CGCAAGGACTAGGCTGAGTCATACAGGAAGCATGAGACTTCTCTGACAATGCCAAGACTCAC<br>AGGATGTCTGGTTCTCTAGAGTTAACAATTGTTAGAGAACACAATTATGGCAAGATGAAGTCA<br>GTGGGGAGAGCTACAGTGTCTCACAGTCCTACATCAGATTCTGCATCTGTAGAGAGCATC<br>AAGCAGTGCGTAGAGCTCGGGCTGGGCATAAAAGTCAGGGCAGAGCCATCTATTGCTTACAT<br>TTGCTTCTGGCGTGGCCACCATGGCTCCTAAGAAGAAGAGGAAGGTGATGAGCCAGTTCGA<br>CATCCTGTGCAAGACCCCCCCCAAGGTGCTGGTGCGGCAGTTCGTGGAGAGATTCGAGAGG<br>CCCAGCGGCGAGAAGATCGCCAGCTGTGCCGCCGAGCTGACCTACCTGTGCTGGATGATCA<br>CCCACAACGGCACCGCCATCAAGAGGGCCACCTTCATGAGCTACAACACCATCATCAGCAAC<br>AGCCTGAGCTTCGACATCGTGAACAAGAGCCTGCAGTTCAAGTACAAGACCCAGAAGGCCAC<br>CATCCTGGAGGCCAGCCTGAAGAAGCTGATCCCCGCCTGGGAGTTCACCATCATCCCTTACA<br>ACGGCCAGAAGCACCAGAGCGACATCACCGACATCGTGTCCAGCCTGCAGCTGCAGTTCGA<br>GAGCAGCGAGGAGGCCGACAAGGGCAACAGCCACAGCAAGAAGATGCTGAAGGCCCTGCT<br>GTCCGAGGGCGAGAGCATCTGGGAGATCACCGAGAAGATCCTGAACAGCTTCGAGTACACC<br>AGCAGGTTCACCAAGACCAAGACCCTGTACCAGTTCCTGTTCCTGGCCACATTCATCAACTG<br>CGGCAGGTTCAGCGACATCAAGAACGTGGACCCCAAGAGCTTCAAGCTGGTGCAGAACAAG<br>TACCTGGGCGTGATCATTCAGTGCCTGGTGACCGAGACCAAGACAAGCGTGTCCAGGCACA<br>TCTACTTTTTCAGCGCCAGAGGCAGGATCGACCCCCTGGTGTACCTGGACGAGTTCCTGAGG<br>AACAGCGAGCCCGTGCTGAAGAGAGTGAACAGGACCGGCAACAGCAGCAGCAACAAGCAG<br>GAGTACCAGCTGCTGAAGGACAACCTGGTGCGCAGCTACAACAAGGCCCTGAAGAAGAACG |

| Fig 26 cont'd |
|---|
| Vector ID (length between ITRs) & Sequence Between ITRs |
| CCCCCTACCCCATCTTCGCTATCAAGAACGGCCCTAAGAGCCACATCGGCAGGCACCTGATG ACCAGCTTTCTGAGCATGAAGGGCCTGACCGAGCTGACAAACGTGGTGGGCAACTGGAGCG ACAAGAGGGCCTCCGCCGTGGCCAGGACCACCTACACCCACCAGATCACCGCCATCCCCGA CCACTACTTCGCCCTGGTGTCCAGGTACTACGCCTACGACCCCATCAGCAAGGAGATGATCG CCCTGAAGGACGAGACCAACCCCATCGAGGAGTGGCAGCACATCGAGCAGCTGAAGGGCA GCGCCGAGGGCAGCATCAGATACCCCGCCTGGAACGGCATCATCAGCCAGGAGGTGCTGG ACTACCTGAGCAGCTACATCAACAGGCGGATCTGAGAATTCGATATCAAGCTTATCGATAATC AACCTCTGGATTACAAAATTTGTGAAAGATTGACTGGTATTCTTAACTATGTTGCTCCTTTTAC GCTATGTGGATACGCTGCTTTAATGCCTTTGTATCATGCTATTGCTTCCCGTATGGCTTTCATT TTCTCCTCCTTGTATAAATCCTGGTTGCTGTCTCTTTATGAGGAGTTGTGGCCCGTTGTCAGG CAACGTGGCGTGGTGTGCACTGTGTTTGCTGACGCAACCCCCACTGGTTGGGGCATTGCCA CCACCTGTCAGCTCCTTTCCGGGACTTTCGCTTTCCCCCTCCCTATTGCCACGGCGGAACTC ATCGCCGCCTGCCTTGCCCGCTGCTGGACAGGGGCTCGGCTGTTGGGCACTGACAATTCCG TGGTGTTGTCGGGGAAATCATCGTCCTTTCCTTGGCTGCTCGCCTATGTTGCCACCTGGATT CTGCGCGGGACGTCCTTCTGCTACGTCCCTTCGGCCCTCAATCCAGCGGACCTTCCTTCCC GCGGCCTGCTGCCGGCTCTGCGGCCTCTTCCGCGTCTTCGCCTTCGCCCTCAGACGAGTCG GATCTCCCTTTGGGCCGCCTCCCCGCATCGATACCGAGCGCTGCTCGAGAGATCTACGGGT GGCATCCCTGTGACCCCTCCCCAGTGCCTCTCCTGGCCCTGGAAGTTGCCACTCCAGTGCC CACCAGCCTTGTCCTAATAAAATTAAGTTGCATCATTTTGTCTGACTAGGTGTCCTTCTATAAT ATTATGGGGTGGAGGGGGGTGGTATGGAGCAAGGGGCAAGTTGGGAAGACAACCTGTAGG GCCTGCGGGGTCTATTGGGAACCAAGCTGGAGTGCAGTGGCACAATCTTGGCTCACTGCAA TCTCCGCCTCCTGGGTTCAAGCGATTCTCCTGCCTCAGCCTCCCGAGTTGTTGGGATTCCAG GCATGCATGACCAGGCTCAGCTAATTTTTGTTTTTTTGGTAGAGACGGGGTTTCACCATATTG GCCAGGCTGGTCTCCAACTCCTAATCTCAGGTGATCTACCCACCTTGGCCTCCCAAATTGCT GGGATTACAGGCGTGAACCACTGCTCCCTTCCCTGTCCTTCTGATTTTGTAGGTAACCACGT GCGGACCGAGCGGCCGC (SEQ ID NO: 292) |
| 3011 (2923) GCGGCCGCACGCGTAGTCTTAGTTTGTCTCAGGAGACAGAAAGAGATGAAGCACAGAAGTC CAGTGGTTAGGGCTGATGCTGTTCCTGAAACCCAACAGGGAGGGGGAGGAAGGGAGAAGG GTCAGCTGTGTTAGGGGCCTCCAGACAAGCTGGCCAGAACAATGAAGAACAAAGCCTGCAC GCTTTTCCGCTGAAGCTCAGAGCCTGGCCTTGGCCTTCTGTGAACAGCTCTAGGAAATGGCT GAGATTCCAGATTTGGAAGGAAGAGACTGGTAAACAGGAGCTGGGCTCTGAGGAGAAGGCA GTCTCTCTGGGTTTCAGGGAGGAGCCAATACAGTCAGCTTAGTTGTTGTGTAGGTTGTGTGC TATGTAGCCATAGAAGACAGGTGTCAGGAGCTCGGGCTGGGCATAAAAGTCAGGGCAGAGC CATCTATTGCTTACATTTGCTTCTGGCGTGGCCACCATGGCTCCTAAGAAGAAGAGGAAGGT GATGAGCCAGTTCGACATCCTGTGCAAGACCCCCCCCAAGGTGCTGGTGCGGCAGTTCGTG GAGAGATTCGAGAGGCCCAGCGGCGAGAAGATCGCCAGCTGTGCCGCCGAGCTGACCTAC CTGTGCTGGATGATCACCCACAACGGCACCGCCATCAAGAGGGCCACCTTCATGAGCTACAA CACCATCATCAGCAACAGCCTGAGCTTCGACATCGTGAACAAGAGCCTGCAGTTCAAGTACA AGACCCAGAAGGCCACCATCCTGGAGGCCAGCCTGAAGAAGCTGATCCCCGCCTGGGAGTT CACCATCATCCCTTACAACGGCCAGAAGCACCAGAGCGACATCACCGACATCGTGTCCAGCC TGCAGCTGCAGTTCGAGAGCAGCGAGGAGGCCGACAAGGGCAACAGCCACAGCAAGAAGA TGCTGAAGGCCCTGCTGTCCGAGGGCGAGAGCATCTGGGAGATCACCGAGAAGATCCTGAA CAGCTTCGAGTACACCAGCAGGTTCACCAAGACCAAGACCCTGTACCAGTTCCTGTTCCTGG CCACATTCATCAACTGCGGCAGGTTCAGCGACATCAAGAACGTGGACCCCAAGAGCTTCAAG CTGGTGCAGAACAAGTACCTGGGCGTGATCATTCAGTGCCTGGTGACCGAGACCAAGACAA GCGTGTCCAGGCACATCTACTTTTTCAGCGCCAGAGGCAGGATCGACCCCCTGGTGTACCT GGACGAGTTCCTGAGGAACAGCGAGCCCGTGCTGAAGAGAGTGAACAGGACCGGCAACAG CAGCAGCAACAAGCAGGAGTACCAGCTGCTGAAGGACAACCTGGTGCGCAGCTACAACAAG |

| Fig 26 cont'd |
|---|
| Vector ID (length between ITRs) & Sequence Between ITRs |
| GCCCTGAAGAAGAACGCCCCCTACCCCATCTTCGCTATCAAGAACGGCCCTAAGAGCCACAT<br>CGGCAGGCACCTGATGACCAGCTTTCTGAGCATGAAGGGCCTGACCGAGCTGACAAACGTG<br>GTGGGCAACTGGAGCGACAAGAGGGCCTCCGCCGTGGCCAGGACCACCTACACCCACCAG<br>ATCACCGCCATCCCCGACCACTACTTCGCCCTGGTGTCCAGGTACTACGCCTACGACCCCAT<br>CAGCAAGGAGATGATCGCCCTGAAGGACGAGACCAACCCCATCGAGGAGTGGCAGCACATC<br>GAGCAGCTGAAGGGCAGCGCCGAGGGCAGCATCAGATACCCCGCCTGGAACGGCATCATC<br>AGCCAGGAGGTGCTGGACTACCTGAGCAGCTACATCAACAGGCGGATCTGAGAATTCGATAT<br>CAAGCTTATCGATAATCAACCTCTGGATTACAAAATTTGTGAAAGATTGACTGGTATTCTTAAC<br>TATGTTGCTCCTTTTACGCTATGTGGATACGCTGCTTTAATGCCTTTGTATCATGCTATTGCTT<br>CCCGTATGGCTTTCATTTTCTCCTCCTTGTATAAATCCTGGTTGCTGTCTCTTTATGAGGAGTT<br>GTGGCCCGTTGTCAGGCAACGTGGCGTGGTGTGCACTGTGTTTGCTGACGCAACCCCCACT<br>GGTTGGGGCATTGCCACCACCTGTCAGCTCCTTTCCGGGACTTTCGCTTTCCCCCTCCCTAT<br>TGCCACGGCGGAACTCATCGCCGCCTGCCTTGCCCGCTGCTGGACAGGGGCTCGGCTGTT<br>GGGCACTGACAATTCCGTGGTGTTGTCGGGGAAATCATCGTCCTTTCCTTGGCTGCTCGCCT<br>ATGTTGCCACCTGGATTCTGCGCGGGACGTCCTTCTGCTACGTCCCTTCGGCCCTCAATCCA<br>GCGGACCTTCCTTCCCGCGGCCTGCTGCCGGCTCTGCGGCCTCTTCCGCGTCTTCGCCTTC<br>GCCCTCAGACGAGTCGGATCTCCCTTTGGGCCGCCTCCCCGCATCGATACCGAGCGCTGCT<br>CGAGAGATCTACGGGTGGCATCCCTGTGACCCCTCCCCAGTGCCTCTCCTGGCCCTGGAAG<br>TTGCCACTCCAGTGCCCACCAGCCTTGTCCTAATAAAATTAAGTTGCATCATTTTGTCTGACTA<br>GGTGTCCTTCTATAATATTATGGGGTGGAGGGGGGTGGTATGGAGCAAGGGGCAAGTTGGG<br>AAGACAACCTGTAGGGCCTGCGGGGGTCTATTGGGAACCAAGCTGGAGTGCAGTGGCACAAT<br>CTTGGCTCACTGCAATCTCCGCCTCCTGGGTTCAAGCGATTCTCCTGCCTCAGCCTCCCGAG<br>TTGTTGGGATTCCAGGCATGCATGACCAGGCTCAGCTAATTTTTGTTTTTTTGGTAGAGACGG<br>GGTTTCACCATATTGGCCAGGCTGGTCTCCAACTCCTAATCTCAGGTGATCTACCCACCTTG<br>GCCTCCCAAATTGCTGGGATTACAGGCGTGAACCACTGCTCCCTTCCCTGTCCTTCTGATTTT<br>GTAGGTAACCACGTGCGGACCGAGCGGCCGC (SEQ ID NO: 293) |
| 3012 (3064)<br>GCGGCCGCACGCGTAGCAGCAAAGAGGATCCCCACCAGACCATACTCTGGAAGCTGCCCTG<br>GGCCAGCCAAGGCCAGCTGGGCCCGGGGTCAGTTGCTGTGGGTCTGAGTGTTCAGCCTGT<br>CCAGCTCAGTGCACCTCGGTGCTGGGGAGGAAGAGGAAATGATGGTTAGGGTAGGAGGGG<br>TGGCAGGGAGAGAGGGTGGGAAGAGTTGTCGCCTGTAGTCCTCCCGTGTCCAGCCCCCACA<br>AGCCCGGGATGGGTGTGGCCTGGAAGTCTCTGGAAGGGGGGGCATTAGAGGTGGGGAGGCA<br>GGTTGTGACAAGGACAGATCTGGGGATGGTTGGGCTCTCTCTCCCATCCCTTCGGTCCCTTC<br>CATCTGCATTGCTGGAGCACGGGAGACAGGAAAGGGAGGAAGCCAGTGGCTTCCGCCTATT<br>GAGAAGGTTTGGAGGCAGGACATTGTTCTGGGGTCTCCCCTCCTCCCAGCACACACACGCT<br>GGGAGGAGGGGAGACACACACACACACACACACAAATACAAAATGAGGAGCTCGGGCTG<br>GGCATAAAAGTCAGGGCAGAGCCATCTATTGCTTACATTTGCTTCTGGCGTGGCCACCATGG<br>CTCCTAAGAAGAAGAGGAAGGTGATGAGCCAGTTCGACATCCTGTGCAAGACCCCCCCCAA<br>GGTGCTGGTGCGGCAGTTCGTGGAGAGATTCGAGAGGCCCAGCGGCGAGAAGATCGCCAG<br>CTGTGCCGCCGAGCTGACCTACCTGTGCTGGATGATCACCCACAACGGCACCGCCATCAAG<br>AGGGCCACCTTCATGAGCTACAACACCATCATCAGCAACAGCCTGAGCTTCGACATCGTGAA<br>CAAGAGCCTGCAGTTCAAGTACAAGACCCAGAAGGCCACCATCCTGGAGGCCAGCCTGAAG<br>AAGCTGATCCCCGCCTGGGAGTTCACCATCATCCCTTACAACGGCCAGAAGCACCAGAGCG<br>ACATCACCGACATCGTGTCCAGCCTGCAGCTGCAGTTCGAGAGCAGCGAGGAGGCCGACAA<br>GGGCAACAGCCACAGCAAGAAGATGCTGAAGGCCCTGCTGTCCGAGGGCGAGAGCATCTG<br>GGAGATCACCGAGAAGATCCTGAACAGCTTCGAGTACACCAGCAGGTTCACCAAGACCAAGA<br>CCCTGTACCAGTTCCTGTTCCTGGCCACATTCATCAACTGCGGCAGGTTCAGCGACATCAAG<br>AACGTGGACCCCAAGAGCTTCAAGCTGGTGCAGAACAAGTACCTGGGCGTGATCATTCAGTG<br>CCTGGTGACCGAGACCAAGACAAGCGTGTCCAGGCACATCTACTTTTTCAGCGCCAGAGGC |

| Fig 26 cont'd |
|---|
| Vector ID (length between ITRs) & Sequence Between ITRs |
| AGGATCGACCCCCTGGTGTACCTGGACGAGTTCCTGAGGAACAGCGAGCCCGTGCTGAAGA GAGTGAACAGGACCGGCAACAGCAGCAGCAACAAGCAGGAGTACCAGCTGCTGAAGGACAA CCTGGTGCGCAGCTACAACAAGGCCCTGAAGAAGAACGCCCCCTACCCCATCTTCGCTATCA AGAACGGCCCTAAGAGCCACATCGGCAGGCACCTGATGACCAGCTTTCTGAGCATGAAGGG CCTGACCGAGCTGACAAACGTGGTGGGCAACTGGAGCGACAAGAGGGCCTCCGCCGTGGC CAGGACCACCTACACCCACCAGATCACCGCCATCCCCGACCACTACTTCGCCCTGGTGTCCA GGTACTACGCCTACGACCCCATCAGCAAGGAGATGATCGCCCTGAAGGACGAGACCAACCC CATCGAGGAGTGGCAGCACATCGAGCAGCTGAAGGGCAGCGCCGAGGGCAGCATCAGATA CCCCGCCTGGAACGGCATCATCAGCCAGGAGGTGCTGGACTACCTGAGCAGCTACATCAAC AGGCGGATCTGAGAATTCGATATCAAGCTTATCGATAATCAACCTCTGGATTACAAAATTTGT GAAAGATTGACTGGTATTCTTAACTATGTTGCTCCTTTTACGCTATGTGGATACGCTGCTTTAA TGCCTTTGTATCATGCTATTGCTTCCCGTATGGCTTTCATTTTCTCCTCCTTGTATAAATCCTG GTTGCTGTCTCTTTATGAGGAGTTGTGGCCCGTTGTCAGGCAACGTGGCGTGGTGTGCACTG TGTTTGCTGACGCAACCCCCACTGGTTGGGGCATTGCCACCACCTGTCAGCTCCTTTCCGGG ACTTTCGCTTTCCCCCTCCCTATTGCCACGGCGGAACTCATCGCCGCCTGCCTTGCCCGCTG CTGGACAGGGGCTCGGCTGTTGGGCACTGACAATTCCGTGGTGTTGTCGGGGAAATCATCG TCCTTTCCTTGGCTGCTCGCCTATGTTGCCACCTGGATTCTGCGCGGGACGTCCTTCTGCTA CGTCCCTTCGGCCCTCAATCCAGCGGACCTTCCTTCCCGCGGCCTGCTGCCGGCTCTGCGG CCTCTTCCGCGTCTTCGCCTTCGCCCTCAGACGAGTCGGATCTCCCTTTGGGCCGCCTCCCC GCATCGATACCGAGCGCTGCTCGAGAGATCTACGGGTGGCATCCCTGTGACCCCTCCCCAG TGCCTCTCCTGGCCCTGGAAGTTGCCACTCCAGTGCCCACCAGCCTTGTCCTAATAAAATTA AGTTGCATCATTTTGTCTGACTAGGTGTCCTTCTATAATATTATGGGGTGGAGGGGGGTGGTA TGGAGCAAGGGGCAAGTTGGGAAGACAACCTGTAGGGCCTGCGGGGTCTATTGGGAACCAA GCTGGAGTGCAGTGGCACAATCTTGGCTCACTGCAATCTCCGCCTCCTGGGTTCAAGCGATT CTCCTGCCTCAGCCTCCCGAGTTGTTGGGATTCCAGGCATGCATGACCAGGCTCAGCTAATT TTTGTTTTTTTGGTAGAGACGGGGTTTCACCATATTGGCCAGGCTGGTCTCCAACTCCTAATC TCAGGTGATCTACCCACCTTGGCCTCCCAAATTGCTGGGATTACAGGCGTGAACCACTGCTC CCTTCCCTGTCCTTCTGATTTTGTAGGTAACCACGTGCGGACCGAGCGGCCGC (SEQ ID NO: 294) |
| 3013 (3094) GCGGCCGCACGCGTCATCTGGTTGGCCTGGACCTAGAGCATGCTGGCCCTGCCACATGGG GTGATTGACTAGGTGTGAGCAGGCCCAATGGAGAAGGGCACTGCATTCCCTCCCCTTGTCA GGCTTGTTCAAGGAACATGGAGAGATACGCCATTTCCAAGCCCACCAGCAACATTCCAGTCT CTCTACACCTTTTCTGATAAGTTATGGGCAGCCTTTTCAGTGATGGCCACCCAGGTAGGTGTA ATGGGGACATGGATGGTTTGATTATGATGGCGGGCATCTTTTTATGTTCATATTTATCATTTTT ATAACTCTCCAGAGAAATGCCTAGACGCTAGCTGGAAACTTTTCAGGAAATGGAAGTGCGTAT GACTGGGAGGAGTTCCTTTTGGGTCACAAACATCCAGAGGAAACAGAGGAGAGCAACACCT GGCAGGGAGGAGGTGGGAGGGGCATCACTGGGAAGGGGAAAGAGGAGGAGACTGCTGAG ATCACTGAAGAGGGGAAGCCAGGCAGTGGTGGTGCACGCCTTTAATCCCAGCACTTGGGAG GCAGAGGCAGAGAGCTCGGGCTGGGCATAAAGTCAGGGCAGAGCCATCTATTGCTTACAT TTGCTTCTGGCGTGGCCACCATGGCTCCTAAGAAGAAGAGGAAGGTGATGAGCCAGTTCGA CATCCTGTGCAAGACCCCCCCCAAGGTGCTGGTGCGGCAGTTCGTGGAGAGATTCGAGAGG CCCAGCGGCGAGAAGATCGCCAGCTGTGCCGCCGAGCTGACCTACCTGTGCTGGATGATCA CCCACAACGGCACCGCCATCAAGAGGGCCACCTTCATGAGCTACAACACCATCATCAGCAAC AGCCTGAGCTTCGACATCGTGAACAAGAGCCTGCAGTTCAAGTACAAGACCCAGAAGGCCAC CATCCTGGAGGCCAGCCTGAAGAAGCTGATCCCCGCCTGGGAGTTCACCATCATCCCTTACA ACGGCCAGAAGCACCAGAGCGACATCACCGACATCGTGTCCAGCCTGCAGCTGCAGTTCGA GAGCAGCGAGGAGGCCGACAAGGGCAACAGCCACAGCAAGAAGATGCTGAAGGCCCTGCT GTCCGAGGGCGAGAGCATCTGGGAGATCACCGAGAAGATCCTGAACAGCTTCGAGTACACC |

| Fig 26 cont'd |
|---|
| Vector ID (length between ITRs) & Sequence Between ITRs |
| AGCAGGTTCACCAAGACCAAGACCCTGTACCAGTTCCTGTTCCTGGCCACATTCATCAACTG CGGCAGGTTCAGCGACATCAAGAACGTGGACCCCAAGAGCTTCAAGCTGGTGCAGAACAAG TACCTGGGCGTGATCATTCAGTGCCTGGTGACCGAGACCAAGACAAGCGTGTCCAGGCACA TCTACTTTTTCAGCGCCAGAGGCAGGATCGACCCCCTGGTGTACCTGGACGAGTTCCTGAGG AACAGCGAGCCCGTGCTGAAGAGAGTGAACAGGACCGGCAACAGCAGCAGCAACAAGCAG GAGTACCAGCTGCTGAAGGACAACCTGGTGCGCAGCTACAACAAGGCCCTGAAGAAGAACG CCCCCTACCCCATCTTCGCTATCAAGAACGGCCCTAAGAGCCACATCGGCAGGCACCTGATG ACCAGCTTTCTGAGCATGAAGGGCCTGACCGAGCTGACAAACGTGGTGGGCAACTGGAGCG ACAAGAGGGCCTCCGCCGTGGCCAGGACCACCTACACCCACCAGATCACCGCCATCCCCGA CCACTACTTCGCCCTGGTGTCCAGGTACTACGCCTACGACCCCATCAGCAAGGAGATGATCG CCCTGAAGGACGAGACCAACCCCATCGAGGAGTGGCAGCACATCGAGCAGCTGAAGGGCA GCGCCGAGGGCAGCATCAGATACCCCGCCTGGAACGGCATCATCAGCCAGGAGGTGCTGG ACTACCTGAGCAGCTACATCAACAGGCGGATCTGAGAATTCGATATCAAGCTTATCGATAATC AACCTCTGGATTACAAAATTTGTGAAAGATTGACTGGTATTCTTAACTATGTTGCTCCTTTTAC GCTATGTGGATACGCTGCTTTAATGCCTTTGTATCATGCTATTGCTTCCCGTATGGCTTTCATT TTCTCCTCCTTGTATAAATCCTGGTTGCTGTCTCTTTATGAGGAGTTGTGGCCCGTTGTCAGG CAACGTGGCGTGGTGTGCACTGTGTTTGCTGACGCAACCCCCACTGGTTGGGGCATTGCCA CCACCTGTCAGCTCCTTTCCGGGACTTTCGCTTTCCCCCTCCCTATTGCCACGGCGGAACTC ATCGCCGCCTGCCTTGCCCGCTGCTGGACAGGGGCTCGGCTGTTGGGCACTGACAATTCCG TGGTGTTGTCGGGGAAATCATCGTCCTTTCCTTGGCTGCTCGCCTATGTTGCCACCTGGATT CTGCGCGGGACGTCCTTCTGCTACGTCCCTTCGGCCCTCAATCCAGCGGACCTTCCTTCCC GCGGCCTGCTGCCGGCTCTGCGGCCTCTTCCGCGTCTTCGCCTTCGCCCTCAGACGAGTCG GATCTCCCTTTGGGCCGCCTCCCCGCATCGATACCGAGCGCTGCTCGAGAGATCTACGGGT GGCATCCCTGTGACCCCTCCCCAGTGCCTCTCCTGGCCCTGGAAGTTGCCACTCCAGTGCC CACCAGCCTTGTCCTAATAAAATTAAGTTGCATCATTTTGTCTGACTAGGTGTCCTTCTATAAT ATTATGGGGTGGAGGGGGGTGGTATGGAGCAAGGGGCAAGTTGGGAAGACAACCTGTAGG GCCTGCGGGGTCTATTGGGAACCAAGCTGGAGTGCAGTGGCACAATCTTGGCTCACTGCAA TCTCCGCCTCCTGGGTTCAAGCGATTCTCCTGCCTCAGCCTCCCGAGTTGTTGGGATTCCAG GCATGCATGACCAGGCTCAGCTAATTTTTGTTTTTTTGGTAGAGACGGGGTTTCACCATATTG GCCAGGCTGGTCTCCAACTCCTAATCTCAGGTGATCTACCCACCTTGGCCTCCCAAATTGCT GGGATTACAGGCGTGAACCACTGCTCCCTTCCCTGTCCTTCTGATTTTGTAGGTAACCACGT GCGGACCGAGCGGCCGC (SEQ ID NO: 295) |
| 3014 (2922) GCGGCCGCACGCGTTCAGTGTGAGGATTTCATTTAAGAAACCCTAACTCAGACATGAAGTAA ACCCTTAGCCTGCAGTTAGCATCCCGGGGATTACAGCTGAAGTGTAGAGGTCAGAGAGTTTC TCACCTCTGGTCCCCTCCCAGTTCTCTAAGGCATGAGGGCCAGGCAGGAAGCATCCGTTTCC TCAAAGCTGCTTCCCTACTGGGACAGAGTCTCAGTCACAAACAACTACCACCACCCCACCCC TCCCTTTCTTCCCTTACTGCTGTGAGCTCAGAACAACCGGACAAAAGTGTATGGGACAAGGA GAGGAGCCGAGAGCAGCCATGGGCTCTGGAGGAACGGGCCTCCTGGGGACGGAGTGGCCT CTGCCTCTGCTGCTGCTTTTCATGAGCTCGGGCTGGGCATAAAAGTCAGGGCAGAGCCATCT ATTGCTTACATTTGCTTCTGGCGTGGCCACCATGGCTCCTAAGAAGAAGAGGAAGGTGATGA GCCAGTTCGACATCCTGTGCAAGACCCCCCCCAAGGTGCTGGTGCGGCAGTTCGTGGAGAG ATTCGAGAGGCCCAGCGGCGAGAAGATCGCCAGCTGTGCCGCCGAGCTGACCTACCTGTGC TGGATGATCACCCACAACGGCACCGCCATCAAGAGGGCCACCTTCATGAGCTACAACACCAT CATCAGCAACAGCCTGAGCTTCGACATCGTGAACAAGAGCCTGCAGTTCAAGTACAAGACCC AGAAGGCCACCATCCTGGAGGCCAGCCTGAAGAAGCTGATCCCCGCCTGGGAGTTCACCAT CATCCCTTACAACGGCCAGAAGCACCAGAGCGACATCACCGACATCGTGTCCAGCCTGCAG CTGCAGTTCGAGAGCAGCGAGGAGGCCGACAAGGGCAACAGCCACAGCAAGAAGATGCTG AAGGCCCTGCTGTCCGAGGGCGAGAGCATCTGGGAGATCACCGAGAAGATCCTGAACAGCT |

| Fig 26 cont'd |
|---|
| Vector ID (length between ITRs) & Sequence Between ITRs |
| TCGAGTACACCAGCAGGTTCACCAAGACCAAGACCCTGTACCAGTTCCTGTTCCTGGCCACA TTCATCAACTGCGGCAGGTTCAGCGACATCAAGAACGTGGACCCCAAGAGCTTCAAGCTGGT GCAGAACAAGTACCTGGGCGTGATCATTCAGTGCCTGGTGACCGAGACCAAGACAAGCGTG TCCAGGCACATCTACTTTTTCAGCGCCAGAGGCAGGATCGACCCCCTGGTGTACCTGGACGA GTTCCTGAGGAACAGCGAGCCCGTGCTGAAGAGAGTGAACAGGACCGGCAACAGCAGCAG CAACAAGCAGGAGTACCAGCTGCTGAAGGACAACCTGGTGCGCAGCTACAACAAGGCCCTG AAGAAGAACGCCCCCTACCCCATCTTCGCTATCAAGAACGGCCCTAAGAGCCACATCGGCAG GCACCTGATGACCAGCTTTCTGAGCATGAAGGGCCTGACCGAGCTGACAAACGTGGTGGGC AACTGGAGCGACAAGAGGGCCTCCGCCGTGGCCAGGACCACCTACACCCACCAGATCACCG CCATCCCCGACCACTACTTCGCCCTGGTGTCCAGGTACTACGCCTACGACCCCATCAGCAAG GAGATGATCGCCCTGAAGGACGAGACCAACCCCATCGAGGAGTGGCAGCACATCGAGCAGC TGAAGGGCAGCGCCGAGGGCAGCATCAGATACCCCGCCTGGAACGGCATCATCAGCCAGG AGGTGCTGGACTACCTGAGCAGCTACATCAACAGGCGGATCTGAGAATTCGATATCAAGCTT ATCGATAATCAACCTCTGGATTACAAAATTTGTGAAAGATTGACTGGTATTCTTAACTATGTTG CTCCTTTTACGCTATGTGGATACGCTGCTTTAATGCCTTTGTATCATGCTATTGCTTCCCGTAT GGCTTTCATTTTCTCCTCCTTGTATAAATCCTGGTTGCTGTCTCTTTATGAGGAGTTGTGGCC CGTTGTCAGGCAACGTGGCGTGGTGTGCACTGTGTTTGCTGACGCAACCCCCACTGGTTGG GGCATTGCCACCACCTGTCAGCTCCTTTCCGGGACTTTCGCTTTCCCCCTCCCTATTGCCAC GGCGGAACTCATCGCCGCCTGCCTTGCCCGCTGCTGGACAGGGGCTCGGCTGTTGGGCAC TGACAATTCCGTGGTGTTGTCGGGGAAATCATCGTCCTTTCCTTGGCTGCTCGCCTATGTTG CCACCTGGATTCTGCGCGGGACGTCCTTCTGCTACGTCCCTTCGGCCCTCAATCCAGCGGA CCTTCCTTCCCGCGGCCTGCTGCCGGCTCTGCGGCCTCTTCCGCGTCTTCGCCTTCGCCCT CAGACGAGTCGGATCTCCCTTTGGGCCGCCTCCCCGCATCGATACCGAGCGCTGCTCGAGA GATCTACGGGTGGCATCCCTGTGACCCCTCCCCAGTGCCTCTCCTGGCCCTGGAAGTTGCC ACTCCAGTGCCCACCAGCCTTGTCCTAATAAAATTAAGTTGCATCATTTTGTCTGACTAGGTG TCCTTCTATAATATTATGGGGTGGAGGGGGGTGGTATGGAGCAAGGGGCAAGTTGGGAAGA CAACCTGTAGGGCCTGCGGGGTCTATTGGGAACCAAGCTGGAGTGCAGTGGCACAATCTTG GCTCACTGCAATCTCCGCCTCCTGGGTTCAAGCGATTCTCCTGCCTCAGCCTCCCGAGTTGT TGGGATTCCAGGCATGCATGACCAGGCTCAGCTAATTTTTGTTTTTTTGGTAGAGACGGGGTT TCACCATATTGGCCAGGCTGGTCTCCAACTCCTAATCTCAGGTGATCTACCCACCTTGGCCT CCCAAATTGCTGGGATTACAGGCGTGAACCACTGCTCCCTTCCCTGTCCTTCTGATTTTGTAG GTAACCACGTGCGGACCGAGCGGCCGC (SEQ ID NO: 296) |
| 3015 (3072) GCGGCCGCACGCGTATGCCATGTGCTGAAACCCCTGGGAGCTGGCTTACCTGGGCTGTAGA ACAGGATAAGAAGAGACAGGCTCCAGCAAGCAAAAGAAGACATCTCAGGTGGGGTCTGTGG GGTCTGTGGAGTCTATGGGCTTCAGGGGCACAGCTGACGGCTGCCTGGAGGGTTAGGGAG AGATGTCTGCTACAGGTCGGGGAGTGAAGCCTGGCGCTCCCAACTGAAATCCACAATCTCCT CTGTGCCAGTGAGCTCATTTCCTCTAATTATCTGAGATCAGGAAACAATATGCACAGACCAGC TCCCAAGCCTTTAGGGCCTCAAGAATTCATGCAGAGGAAGCCAGGAAGCAGCAGATAAGCA GGGGTGTAACAGGGTTCTCTCACGTTGCATGCTCCCTGTGCGGGGATAGGAAAGCAATGGG AAATCACATGCAGGAAGTGTGTGTGCATGCATGAATGTGTGCAAGCTTGCATGCACTTACGT GTTTTGTGTGTGGGTGGGGGGAGTGTACATGGAATTTCTTTAACTGTACATTGAGCTCGGGC TGGGCATAAAAGTCAGGGCAGAGCCATCTATTGCTTACATTTGCTTCTGGCGTGGCCACCAT GGCTCCTAAGAAGAAGAGGAAGGTGATGAGCCAGTTCGACATCCTGTGCAAGACCCCCCCC AAGGTGCTGGTGCGGCAGTTCGTGGAGAGATTCGAGAGGCCCAGCGGCGAGAAGATCGCC AGCTGTGCCGCCGAGCTGACCTACCTGTGCTGGATGATCACCCACAACGGCACCGCCATCA AGAGGGCCACCTTCATGAGCTACAACACCATCATCAGCAACAGCCTGAGCTTCGACATCGTG AACAAGAGCCTGCAGTTCAAGTACAAGACCCAGAAGGCCACCATCCTGGAGGCCAGCCTGA AGAAGCTGATCCCCGCCTGGGAGTTCACCATCATCCCTTACAACGGCCAGAAGCACCAGAG |

| Fig 26 cont'd |
| Vector ID (length between ITRs) & Sequence Between ITRs |

CGACATCACCGACATCGTGTCCAGCCTGCAGCTGCAGTTCGAGAGCAGCGAGGAGGCCGAC
AAGGGCAACAGCCACAGCAAGAAGATGCTGAAGGCCCTGCTGTCCGAGGGCGAGAGCATCT
GGGAGATCACCGAGAAGATCCTGAACAGCTTCGAGTACACCAGCAGGTTCACCAAGACCAA
GACCCTGTACCAGTTCCTGTTCCTGGCCACATTCATCAACTGCGGCAGGTTCAGCGACATCA
AGAACGTGGACCCCAAGAGCTTCAAGCTGGTGCAGAACAAGTACCTGGGCGTGATCATTCA
GTGCCTGGTGACCGAGACCAAGACAAGCGTGTCCAGGCACATCTACTTTTTCAGCGCCAGA
GGCAGGATCGACCCCCTGGTGTACCTGGACGAGTTCCTGAGGAACAGCGAGCCCGTGCTGA
AGAGAGTGAACAGGACCGGCAACAGCAGCAGCAACAAGCAGGAGTACCAGCTGCTGAAGGA
CAACCTGGTGCGCAGCTACAACAAGGCCCTGAAGAAGAACGCCCCCTACCCCATCTTCGCTA
TCAAGAACGGCCCTAAGAGCCACATCGGCAGGCACCTGATGACCAGCTTTCTGAGCATGAA
GGGCCTGACCGAGCTGACAAACGTGGTGGGCAACTGGAGCGACAAGAGGGCCTCCGCCGT
GGCCAGGACCACCTACACCCACCAGATCACCGCCATCCCCGACCACTACTTCGCCCTGGTG
TCCAGGTACTACGCCTACGACCCCATCAGCAAGGAGATGATCGCCCTGAAGGACGAGACCA
ACCCCATCGAGGAGTGGCAGCACATCGAGCAGCTGAAGGGCAGCGCCGAGGGCAGCATCA
GATACCCCGCCTGGAACGGCATCATCAGCCAGGAGGTGCTGGACTACCTGAGCAGCTACAT
CAACAGGCGGATCTGAGAATTCGATATCAAGCTTATCGATAATCAACCTCTGGATTACAAAAT
TTGTGAAAGATTGACTGGTATTCTTAACTATGTTGCTCCTTTTACGCTATGTGGATACGCTGCT
TTAATGCCTTTGTATCATGCTATTGCTTCCCGTATGGCTTTCATTTTCTCCTCCTTGTATAAATC
CTGGTTGCTGTCTCTTTATGAGGAGTTGTGGCCCGTTGTCAGGCAACGTGGCGTGGTGTGCA
CTGTGTTTGCTGACGCAACCCCCACTGGTTGGGGCATTGCCACCACCTGTCAGCTCCTTTCC
GGGACTTTCGCTTTCCCCCTCCCTATTGCCACGGCGGAACTCATCGCCGCCTGCCTTGCCC
GCTGCTGGACAGGGGCTCGGCTGTTGGGCACTGACAATTCCGTGGTGTTGTCGGGGAAATC
ATCGTCCTTTCCTTGGCTGCTCGCCTATGTTGCCACCTGGATTCTGCGCGGGACGTCCTTCT
GCTACGTCCCTTCGGCCCTCAATCCAGCGGACCTTCCTTCCCGCGGCCTGCTGCCGGCTCT
GCGGCCTCTTCCGCGTCTTCGCCTTCGCCCTCAGACGAGTCGGATCTCCCTTTGGGCCGCC
TCCCCGCATCGATACCGAGCGCTGCTCGAGAGATCTACGGGTGGCATCCCTGTGACCCCTC
CCCAGTGCCTCTCCTGGCCCTGGAAGTTGCCACTCCAGTGCCCACCAGCCTTGTCCTAATAA
AATTAAGTTGCATCATTTTGTCTGACTAGGTGTCCTTCTATAATATTATGGGGTGGAGGGGGG
TGGTATGGAGCAAGGGGCAAGTTGGGAAGACAACCTGTAGGGCCTGCGGGGTCTATTGGGA
ACCAAGCTGGAGTGCAGTGGCACAATCTTGGCTCACTGCAATCTCCGCCTCCTGGGTTCAAG
CGATTCTCCTGCCTCAGCCTCCCGAGTTGTTGGGATTCCAGGCATGCATGACCAGGCTCAGC
TAATTTTTGTTTTTTTGGTAGAGACGGGGTTTCACCATATTGGCCAGGCTGGTCTCCAACTCC
TAATCTCAGGTGATCTACCCACCTTGGCCTCCCAAATTGCTGGGATTACAGGCGTGAACCAC
TGCTCCCTTCCCTGTCCTTCTGATTTTGTAGGTAACCACGTGCGGACCGAGCGGCCGC (SEQ
ID NO: 297)

3016 (3109)
GCGGCCGCACGCGTGACGCTGAGCAGCGGCTGCCTCACCTGCCGGGCGCTCCGCAGCTAC
CCAATCAGCTGGGGTCGCCCGGCAGCGGCTGCCATGTTCTCCGCTTCGCGCTGCCAATCAT
TGTGTCGGTGGCCAATGGGCGACAGGGCCGGGGGTCAGGTGATCTCAGGCCAGCTGGCTC
CCCATTGGTGCGCGCTGCCCAGCCTCCCGCTCGGTTTATGTGCGAGGAGTGAGTGATTGAC
TTTATCAGTCCAAGGACATTACTCTGGAGGTGAAGAGGCTTGGACTCGCGAAGCGAGCAGTG
AGGTTCGAGCCTGCTTACTGCAGGCTGCCTGCCCTCTGGCCACGTTCCGCCTCTGCTTCTTG
GTGCAGTTGCTCCTGAAAGCCGGGACCCGAGGAGCCTCTGGCCCCGTGGTTCCGCGCTCTT
GAGTAGAGGAGGGGTGTCCGGGACAGGATTGACAAACCCCGCCCTCCACTTATTATTTTGCT
TATTTTTCTTTGTGCGCTCCTGTTAGTTTGTTAAGCAGATTTAGTCCTAGAGTCTTTTCTCCTC
CCTTCTCCTCCCTCCTCCTCTCCCATCGAGCTCGGGCTGGGCATAAAAGTCAGGGCAGAGC
CATCTATTGCTTACATTTGCTTCTGGCGTGGCCACCATGGCTCCTAAGAAGAAGAGGAAGGT
GATGAGCCAGTTCGACATCCTGTGCAAGACCCCCCCCAAGGTGCTGGTGCGGCAGTTCGTG
GAGAGATTCGAGAGGCCCAGCGGCGAGAAGATCGCCAGCTGTGCCGCCGAGCTGACCTAC

| Fig 26 cont'd |
|---|
| Vector ID (length between ITRs) & Sequence Between ITRs |
| CTGTGCTGGATGATCACCCACAACGGCACCGCCATCAAGAGGGCCACCTTCATGAGCTACAA CACCATCATCAGCAACAGCCTGAGCTTCGACATCGTGAACAAGAGCCTGCAGTTCAAGTACA AGACCCAGAAGGCCACCATCCTGGAGGCCAGCCTGAAGAAGCTGATCCCCGCCTGGGAGTT CACCATCATCCCTTACAACGGCCAGAAGCACCAGAGCGACATCACCGACATCGTGTCCAGCC TGCAGCTGCAGTTCGAGAGCAGCGAGGAGGCCGACAAGGGCAACAGCCACAGCAAGAAGA TGCTGAAGGCCCTGCTGTCCGAGGGCGAGAGCATCTGGGAGATCACCGAGAAGATCCTGAA CAGCTTCGAGTACACCAGCAGGTTCACCAAGACCAAGACCCTGTACCAGTTCCTGTTCCTGG CCACATTCATCAACTGCGGCAGGTTCAGCGACATCAAGAACGTGGACCCCAAGAGCTTCAAG CTGGTGCAGAACAAGTACCTGGGCGTGATCATTCAGTGCCTGGTGACCGAGACCAAGACAA GCGTGTCCAGGCACATCTACTTTTTCAGCGCCAGAGGCAGGATCGACCCCCTGGTGTACCT GGACGAGTTCCTGAGGAACAGCGAGCCCGTGCTGAAGAGAGTGAACAGGACCGGCAACAG CAGCAGCAACAAGCAGGAGTACCAGCTGCTGAAGGACAACCTGGTGCGCAGCTACAACAAG GCCCTGAAGAAGAACGCCCCCTACCCCATCTTCGCTATCAAGAACGGCCCTAAGAGCCACAT CGGCAGGCACCTGATGACCAGCTTTCTGAGCATGAAGGGCCTGACCGAGCTGACAAACGTG GTGGGCAACTGGAGCGACAAGAGGGCCTCCGCCGTGGCCAGGACCACCTACACCCACCAG ATCACCGCCATCCCCGACCACTACTTCGCCCTGGTGTCCAGGTACTACGCCTACGACCCCAT CAGCAAGGAGATGATCGCCCTGAAGGACGAGACCAACCCCATCGAGGAGTGGCAGCACATC GAGCAGCTGAAGGGCAGCGCCGAGGGCAGCATCAGATACCCCGCCTGGAACGGCATCATC AGCCAGGAGGTGCTGGACTACCTGAGCAGCTACATCAACAGGCGGATCTGAGAATTCGATAT CAAGCTTATCGATAATCAACCTCTGGATTACAAAATTTGTGAAAGATTGACTGGTATTCTTAAC TATGTTGCTCCTTTTACGCTATGTGGATACGCTGCTTTAATGCCTTTGTATCATGCTATTGCTT CCCGTATGGCTTTCATTTTCTCCTCCTTGTATAAATCCTGGTTGCTGTCTCTTTATGAGGAGTT GTGGCCCGTTGTCAGGCAACGTGGCGTGGTGTGCACTGTGTTTGCTGACGCAACCCCCACT GGTTGGGGCATTGCCACCACCTGTCAGCTCCTTTCCGGGACTTTCGCTTTCCCCCTCCCTAT TGCCACGGCGGAACTCATCGCCGCCTGCCTTGCCCGCTGCTGGACAGGGGCTCGGCTGTT GGGCACTGACAATTCCGTGGTGTTGTCGGGGAAATCATCGTCCTTTCCTTGGCTGCTCGCCT ATGTTGCCACCTGGATTCTGCGCGGGACGTCCTTCTGCTACGTCCCTTCGGCCCTCAATCCA GCGGACCTTCCTTCCCGCGGCCTGCTGCCGGCTCTGCGGCCTCTTCCGCGTCTTCGCCTTC GCCCTCAGACGAGTCGGATCTCCCTTTGGGCCGCCTCCCCGCATCGATACCGAGCGCTGCT CGAGAGATCTACGGGTGGCATCCCTGTGACCCCTCCCCAGTGCCTCTCCTGGCCCTGGAAG TTGCCACTCCAGTGCCCACCAGCCTTGTCCTAATAAAATTAAGTTGCATCATTTTGTCTGACTA GGTGTCCTTCTATAATATTATGGGGTGGAGGGGGGTGGTATGGAGCAAGGGGCAAGTTGGG AAGACAACCTGTAGGGCCTGCGGGGTCTATTGGGAACCAAGCTGGAGTGCAGTGGCACAAT CTTGGCTCACTGCAATCTCCGCCTCCTGGGTTCAAGCGATTCTCCTGCCTCAGCCTCCCGAG TTGTTGGGATTCCAGGCATGCATGACCAGGCTCAGCTAATTTTTGTTTTTTTGGTAGAGACGG GGTTTCACCATATTGGCCAGGCTGGTCTCCAACTCCTAATCTCAGGTGATCTACCCACCTTG GCCTCCCAAATTGCTGGGATTACAGGCGTGAACCACTGCTCCCTTCCCTGTCCTTCTGATTTT GTAGGTAACCACGTGCGGACCGAGCGGCCGC (SEQ ID NO: 298) |
| 3017 (4290) GCGGCCGCACGCGTTACCCTATTTCTGGGATTTAAGCTTCAGAACTGGGCACAATCTCAACC ATTATCCTCTGCTGCAGAATGAAAACCTCCCCAGCCTTGATAAGCAGGAAGGGAGGTCACCT CACCCGCTCTGGGAACCTGCAGCCTCCACCTGCTGAGGGGCTGGCTCTCTGGAGAAGGGAA CACATACCACAGGGGACACCCCTTCACTCTCCTGTGCATAAACACCTCTCCGCTGGAGAGC TGCCTAACTTTTCTATGGGGTTAGCACTTCTGTCTAGTAGGTCGCACTTGGGCTGCTCTGTCT GTCTGTGGATCTTGTCTCTGGTTTCCATGGTTCGTGTAACAAGTGGGACTCTTGAAGTCAAAC AGGTGGGAGGTGTTCCTTGACCACGCATGTGTGGGATGCCATCTGCCTGCAGTCCCACTAG CACCCGAGGCTGACCCCAGGCTCACCAGCGTGTGGCTGGTCACTAGCCCGATGGGAACAC GGCACAGAGGCAAGTGTGGCGAGTCACTACCTAGGCAGAACGGGAAGGAGCACATGAAACA GGCTGGCATTGAACTTGACAGAGATGGCAGAGATTAAGAAGGCAGGGAGAACAATGGGGGG |

| Fig 26 cont'd |
| --- |
| Vector ID (length between ITRs) & Sequence Between ITRs |
| AAAGCCAGAACCAGGGGTTTGAGGAGAAACTGTAGGGGCTGCTGAGGCAGAGCTTTCCTGA
AGGGAAAAAGAACAGTAAGAAAAACAAACTCCATTTCACAGAGGCAACAATAGAACAATCTTG
CTTCTTCTGCCCTCAAGTTTATTGGCCTCCAGAGGCTCTGTGCTTCCAAAGATTAGCCTTCCC
CTGGGAAATTAGGAAGCAAATATTAGTTCTCCTCTCATGAGGTCATTCCTTGTAGAACGCTTC
CTCGGGAGCTCTGCGCTGCTTGGCTTTCGAAGCCCCATGCCCACCCGGAGTTTCAACCTGG
AGTCAGGGAAAGGCTTAGAAATTATCTTTGAATCCCAGGAAGACAAAACAGGAATGGCCTCA
AGCAGGGCTTCCTTCTGAAACCTGGGGAAATGGCTACTTCTGCCTGGCCTGAATTCAGGGGA
ACAGTGCACCCCACCTGCTCCGACTGGCAGTTAAGGAGGGCCACATTGAAGGCAGCAGACT
CCCAGCTGTGCTGGCGGGACAAAGCCTTGATTTTTTTTTTTTAAATCTCTGATTAGTCATTGTG
TATAAGAAATGTTTTGAGTTAAAATAATATACAAGAATTTCCTTAGAAAAGAAAATACACACGC
TCATTTTTTGGATCCACTTAACACACTTAGCAAAAGGACATTTGGAACAACATGACACGTCTTA
GCTTCGGAGAAGGGTGGGGTGGACTCATGCCATCACAATGGAGATGGATGTGTGGTTTATTG
GCCTCTCAGCCACACACAGGTGAGTGACAGGCCACTGTTATTCAACTGTTTAATGCCAGCTT
CTCATAAATCAAGGTGACGCCTGAAAAGATTGAGTCTTTAAATCAAACTGCCTTTTCCTATTTC
GAATATAATTTGGGCTGTTGCCAAGGACTCTGGGAAACAGAGGACTACAAGTGCCATTTCAA
CAAGAAACACACCCATTTAGGACCGGATGCAGAGCTCAGGGCTCCGGACCACTTGCCAACA
GAGTTTCACAGTCACATGACAGTGACATACTGCTAATGGGGTTAGCAAGTGACTCATGGTCT
CATATCTGGAGAATGAAGACTGGGGTGGGTGTTAGCTTCCAGGACCGCCATAACCAACATGC
CAGTATGACAGACTGCCCCGTGGAGCTCGGGCTGGGCATAAAAGTCAGGGCAGAGCCATCT
ATTGCTTACATTTGCTTCTGGCGTGGCCACCATGGCTCCTAAGAAGAAGAGGAAGGTGATGA
GCCAGTTCGACATCCTGTGCAAGACCCCCCCCAAGGTGCTGGTGCGGCAGTTCGTGGAGAG
ATTCGAGAGGCCCAGCGGCGAGAAGATCGCCAGCTGTGCCGCCGAGCTGACCTACCTGTGC
TGGATGATCACCCACAACGGCACCGCCATCAAGAGGGCCACCTTCATGAGCTACAACACCAT
CATCAGCAACAGCCTGAGCTTCGACATCGTGAACAAGAGCCTGCAGTTCAAGTACAAGACCC
AGAAGGCCACCATCCTGGAGGCCAGCCTGAAGAAGCTGATCCCCGCCTGGGAGTTCACCAT
CATCCCTTACAACGGCCAGAAGCACCAGAGCGACATCACCGACATCGTGTCCAGCCTGCAG
CTGCAGTTCGAGAGCAGCGAGGAGGCCGACAAGGGCAACAGCCACAGCAAGAAGATGCTG
AAGGCCCTGCTGTCCGAGGGCGAGAGCATCTGGGAGATCACCGAGAAGATCCTGAACAGCT
TCGAGTACACCAGCAGGTTCACCAAGACCAAGACCCTGTACCAGTTCCTGTTCCTGGCCACA
TTCATCAACTGCGGCAGGTTCAGCGACATCAAGAACGTGGACCCCAAGAGCTTCAAGCTGGT
GCAGAACAAGTACCTGGGCGTGATCATTCAGTGCCTGGTGACCGAGACCAAGACAAGCGTG
TCCAGGCACATCTACTTTTTCAGCGCCAGAGGCAGGATCGACCCCCTGGTGTACCTGGACGA
GTTCCTGAGGAACAGCGAGCCCGTGCTGAAGAGAGTGAACAGGACCGGCAACAGCAGCAG
CAACAAGCAGGAGTACCAGCTGCTGAAGGACAACCTGGTGCGCAGCTACAACAAGGCCCTG
AAGAAGAACGCCCCCTACCCCATCTTCGCTATCAAGAACGGCCCTAAGAGCCACATCGGCAG
GCACCTGATGACCAGCTTTCTGAGCATGAAGGGCCTGACCGAGCTGACAAACGTGGTGGGC
AACTGGAGCGACAAGAGGGCCTCCGCCGTGGCCAGGACCACCTACACCCACCAGATCACCG
CCATCCCCGACCACTACTTCGCCCTGGTGTCCAGGTACTACGCCTACGACCCCATCAGCAAG
GAGATGATCGCCCTGAAGGACGAGACCAACCCCATCGAGGAGTGGCAGCACATCGAGCAGC
TGAAGGGCAGCGCCGAGGGCAGCATCAGATACCCCGCCTGGAACGGCATCATCAGCCAGG
AGGTGCTGGACTACCTGAGCAGCTACATCAACAGGCGGATCTGAGAATTCGATATCAAGCTT
ATCGATAATCAACCTCTGGATTACAAAATTTGTGAAAGATTGACTGGTATTCTTAACTATGTTG
CTCCTTTTACGCTATGTGGATACGCTGCTTTAATGCCTTTGTATCATGCTATTGCTTCCCGTAT
GGCTTTCATTTTCTCCTCCTTGTATAAATCCTGGTTGCTGTCTCTTTATGAGGAGTTGTGGCC
CGTTGTCAGGCAACGTGGCGTGGTGTGCACTGTGTTTGCTGACGCAACCCCCACTGGTTGG
GGCATTGCCACCACCTGTCAGCTCCTTTCCGGGACTTTCGCTTTCCCCCTCCCTATTGCCAC
GGCGGAACTCATCGCCGCCTGCCTTGCCCGCTGCTGGACAGGGGCTCGGCTGTTGGGCAC
TGACAATTCCGTGGTGTTGTCGGGGAAATCATCGTCCTTTCCTTGGCTGCTCGCCTATGTTG
CCACCTGGATTCTGCGCGGGACGTCCTTCTGCTACGTCCCTTCGGCCCTCAATCCAGCGGA |

| Fig 26 cont'd |
| Vector ID (length between ITRs) & Sequence Between ITRs |
| CCTTCCTTCCCGCGGCCTGCTGCCGGCTCTGCGGCCTCTTCCGCGTCTTCGCCTTCGCCCT CAGACGAGTCGGATCTCCCTTTGGGCCGCCTCCCCGCATCGATACCGAGCGCTGCTCGAGA GATCTACGGGTGGCATCCCTGTGACCCCTCCCCAGTGCCTCTCCTGGCCCTGGAAGTTGCC ACTCCAGTGCCCACCAGCCTTGTCCTAATAAAATTAAGTTGCATCATTTTGTCTGACTAGGTG TCCTTCTATAATATTATGGGGTGGAGGGGGGTGGTATGGAGCAAGGGGCAAGTTGGGAAGA CAACCTGTAGGGCCTGCGGGGTCTATTGGGAACCAAGCTGGAGTGCAGTGGCACAATCTTG GCTCACTGCAATCTCCGCCTCCTGGGTTCAAGCGATTCTCCTGCCTCAGCCTCCCGAGTTGT TGGGATTCCAGGCATGCATGACCAGGCTCAGCTAATTTTTGTTTTTTGGTAGAGACGGGGTT TCACCATATTGGCCAGGCTGGTCTCCAACTCCTAATCTCAGGTGATCTACCCACCTTGGCCT CCCAAATTGCTGGGATTACAGGCGTGAACCACTGCTCCCTTCCCTGTCCTTCTGATTTTGTAG GTAACCACGTGCGGACCGAGCGGCCGC (SEQ ID NO: 299) |
| 3018 (3231) GCGGCCGCACGCGTCGGAAGAGCATAGAGCGTGCCTGTGGCTCACAGTCTTTGAACATGGA TCTCTGAGCACCTGCAGGAGCCAGGCTCTGCAGGGCACAGCGGCTTAGACATCTAGACCTA GGCTTCCAAGTGACCCCCAGGAAAATCCTCTGCTTTTCCTACCCCCATGGCGTTCACAGGCT TGCCTCCATCGTAAGGTCAGGACGTCGGCAAGCACAGCCACAGGACTAGGCCAGCCAACTG TCTCTGTCCCAGGCGGCAGGCTCTGACGTGTTCCTCTGGGTTTGGAGTCAAGGCCTGCCGT GTTTGTTCCCTCTCACCAGGAAGTGAGGGCTTTCCTTCCTGAAGCTTGGGAGGCCACGTTCC TTTTCACTCCCCAAAGAGGAAGCCTTCTCTGTCCTCAGGCCAGATATGTGGAGGGCTGACTT CATGGCCTGAGACGAGTGCACAGGAAGCCGTCTTACCTAAGAAGCCCTGGAGGAAGCCTCC ACAGGCCCCACAGGAAGCACAGCCACGTCACCTTCTCCAGCAGGGAGGCCAGTCTCTGCCC AGCTCCATCCCACCTGACCTGCCATCTGCCCAGCCTCCAACCCCTGAGACGTCTCCTTTCTG GCCTCCTCAGGCTCCTGAGCACATTTGTGAGTTTACAAAGATCAGAGGTCGCCGGAGATCAG AACCAGTGCACCCCACTGCCCCGCAGGAGCTCGGGCTGGGCATAAAAGTCAGGGCAGAGC CATCTATTGCTTACATTTGCTTCTGGCGTGGCCACCATGGCTCCTAAGAAGAAGAGGAAGGT GATGAGCCAGTTCGACATCCTGTGCAAGACCCCCCCCAAGGTGCTGGTGCGGCAGTTCGTG GAGAGATTCGAGAGGCCCAGCGGCGAGAAGATCGCCAGCTGTGCCGCCGAGCTGACCTAC CTGTGCTGGATGATCACCCACAACGGCACCGCCATCAAGAGGGCCACCTTCATGAGCTACAA CACCATCATCAGCAACAGCCTGAGCTTCGACATCGTGAACAAGAGCCTGCAGTTCAAGTACA AGACCCAGAAGGCCACCATCCTGGAGGCCAGCCTGAAGAAGCTGATCCCCGCCTGGGAGTT CACCATCATCCCTTACAACGGCCAGAAGCACCAGAGCGACATCACCGACATCGTGTCCAGCC TGCAGCTGCAGTTCGAGAGCAGCGAGGAGGCCGACAAGGGCAACAGCCACAGCAAGAAGA TGCTGAAGGCCCTGCTGTCCGAGGGCGAGAGCATCTGGGAGATCACCGAGAAGATCCTGAA CAGCTTCGAGTACACCAGCAGGTTCACCAAGACCAAGACCCTGTACCAGTTCCTGTTCCTGG CCACATTCATCAACTGCGGCAGGTTCAGCGACATCAAGAACGTGGACCCCAAGAGCTTCAAG CTGGTGCAGAACAAGTACCTGGGCGTGATCATTCAGTGCCTGGTGACCGAGACCAAGACAA GCGTGTCCAGGCACATCTACTTTTTCAGCGCCAGAGGCAGGATCGACCCCCTGGTGTACCT GGACGAGTTCCTGAGGAACAGCGAGCCCGTGCTGAAGAGAGTGAACAGGACCGGCAACAG CAGCAGCAACAAGCAGGAGTACCAGCTGCTGAAGGACAACCTGGTGCGCAGCTACAACAAG GCCCTGAAGAAGAACGCCCCCTACCCCATCTTCGCTATCAAGAACGGCCCTAAGAGCCACAT CGGCAGGCACCTGATGACCAGCTTTCTGAGCATGAAGGGCCTGACCGAGCTGACAAACGTG GTGGGCAACTGGAGCGACAAGAGGGCCTCCGCCGTGGCCAGGACCACCTACACCCACCAG ATCACCGCCATCCCCGACCACTACTTCGCCCTGGTGTCCAGGTACTACGCCTACGACCCCAT CAGCAAGGAGATGATCGCCCTGAAGGACGAGACCAACCCCATCGAGGAGTGGCAGCACATC GAGCAGCTGAAGGGCAGCGCCGAGGGCAGCATCAGATACCCCGCCTGGAACGGCATCATC AGCCAGGAGGTGCTGGACTACCTGAGCAGCTACATCAACAGGCGGATCTGAGAATTCGATAT CAAGCTTATCGATAATCAACCTCTGGATTACAAAATTTGTGAAAGATTGACTGGTATTCTTAAC TATGTTGCTCCTTTTACGCTATGTGGATACGCTGCTTTAATGCCTTTGTATCATGCTATTGCTT CCCGTATGGCTTTCATTTTCTCCTCCTTGTATAAATCCTGGTTGCTGTCTCTTTATGAGGAGTT |

| Fig 26 cont'd |
|---|
| Vector ID (length between ITRs) & Sequence Between ITRs |
| GTGGCCCGTTGTCAGGCAACGTGGCGTGGTGTGCACTGTGTTTGCTGACGCAACCCCCACT GGTTGGGGCATTGCCACCACCTGTCAGCTCCTTTCCGGGACTTTCGCTTTCCCCCTCCCTAT TGCCACGGCGGAACTCATCGCCGCCTGCCTTGCCCGCTGCTGGACAGGGGCTCGGCTGTT GGGCACTGACAATTCCGTGGTGTTGTCGGGGAAATCATCGTCCTTTCCTTGGCTGCTCGCCT ATGTTGCCACCTGGATTCTGCGCGGGACGTCCTTCTGCTACGTCCCTTCGGCCCTCAATCCA GCGGACCTTCCTTCCCGCGGCCTGCTGCCGGCTCTGCGGCCTCTTCCGCGTCTTCGCCTTC GCCCTCAGACGAGTCGGATCTCCCTTTGGGCCGCCTCCCCGCATCGATACCGAGCGCTGCT CGAGAGATCTACGGGTGGCATCCCTGTGACCCCTCCCCAGTGCCTCTCCTGGCCCTGGAAG TTGCCACTCCAGTGCCCACCAGCCTTGTCCTAATAAAATTAAGTTGCATCATTTTGTCTGACTA GGTGTCCTTCTATAATATTATGGGGTGGAGGGGGGTGGTATGGAGCAAGGGGCAAGTTGGG AAGACAACCTGTAGGGCCTGCGGGGTCTATTGGGAACCAAGCTGGAGTGCAGTGGCACAAT CTTGGCTCACTGCAATCTCCGCCTCCTGGGTTCAAGCGATTCTCCTGCCTCAGCCTCCCGAG TTGTTGGGATTCCAGGCATGCATGACCAGGCTCAGCTAATTTTTGTTTTTTTGGTAGAGACGG GGTTTCACCATATTGGCCAGGCTGGTCTCCAACTCCTAATCTCAGGTGATCTACCCACCTTG GCCTCCCAAATTGCTGGGATTACAGGCGTGAACCACTGCTCCCTTCCCTGTCCTTCTGATTTT GTAGGTAACCACGTGCGGACCGAGCGGCCGC (SEQ ID NO: 300) |
| 3019 (3575) GCGGCCGCACGCGTTGGCTCTATTGGTGCTAGAGTTGAGGAGAATTCAAAAGGAGACAAAG GGATTCTTCCTTTGATCCCTGCTAGCGTGGAGAGGAGAGTTTCAGCCCCTGAGGAACCCTGC AGACATCTCTGGGAGGTGAGGAGGCCCATCCTGGAGCAAACTCTGCTATTTCCAGAAGAACG AGAATAAGTCATAAGAGGCCACTGGCTGGTTTGTATTAATTGTCACTATTAACAGTGTAAAACT TCAAAGGAGAGAATGACTGGCAACAAAATTAGTTTATTATACTGGGTACAATAGAAATTAGAC TAGTCCCCTCCTCTTGTCCCCTTTAAGGGATTTCCTAAGGCCACTGGGAACACCATCCCTGG ACTTTCAGGGTGGGCTGCAAGGCTCAAGCTGGTTGCCAGGAAGTTGTGCCGGGCCAACCCC ATGTTCCTTCTCTGGCCTTTGTCTGCTGGTTTCAAAGGCATTCCTTGGGAAAGGGCATTGGTT GGTGTAAACAGCTTTGAATCTGAAGAGTCTCACCCCTCTCTGGAGCACTTGGAAGGTCCAGG GTTTTCCTTCTAGGAAGTGGGAACAATGGGAAGACTTTATTTTAGCAGCAAGCAGGACTTGTG ATAAGAGTGCACCTCAGAGCTGGTCTCTGTGTGTCTAGTTAATGACCAAACATGGGGAGGAG CAAGAATACCAGCGTTGCCTTAGGATGAAATGACTGACATTCCTGAAGCAGCCCCAGATTCC TCACATCCCAACTGGCAAGACTCAAGTTCACCCACTTGTGAAGAGGACACATGACAGCCCTC AGTCCTTCCCTTGGCTTTCAGCTTATTGTGTCGAATGACCTCTCTTCAACTAGAGAGTAATGA TGGATGATTGGACCATTGTTTGCTAGGCTTAACTGTGTCAGGGGTCAAGATCCAGAGCTACA GAGAATTCAGCTTTCATGGGGAAAAAACCTAGAAGAAGACTTCCTTCATGTGGCTAAATATT TGGACATCAGAAGGCAGTGGCTCTGCAGAAGCAATCTGAAAGGGCAGACGAGCTCGGGCTG GGCATAAAAGTCAGGGCAGAGCCATCTATTGCTTACATTTGCTTCTGGCGTGGCCACCATGG CTCCTAAGAAGAAGAGGAAGGTGATGAGCCAGTTCGACATCCTGTGCAAGACCCCCCCCAA GGTGCTGGTGCGGCAGTTCGTGGAGAGATTCGAGAGGCCCAGCGGCGAGAAGATCGCCAG CTGTGCCGCCGAGCTGACCTACCTGTGCTGGATGATCACCCACAACGGCACCGCCATCAAG AGGGCCACCTTCATGAGCTACAACACCATCATCAGCAACAGCCTGAGCTTCGACATCGTGAA CAAGAGCCTGCAGTTCAAGTACAAGACCCAGAAGGCCACCATCCTGGAGGCCAGCCTGAAG AAGCTGATCCCCGCCTGGGAGTTCACCATCATCCCTTACAACGGCCAGAAGCACCAGAGCG ACATCACCGACATCGTGTCCAGCCTGCAGCTGCAGTTCGAGAGCAGCGAGGAGGCCGACAA GGGCAACAGCCACAGCAAGAAGATGCTGAAGGCCCTGCTGTCCGAGGGCGAGAGCATCTG GGAGATCACCGAGAAGATCCTGAACAGCTTCGAGTACACCAGCAGGTTCACCAAGACCAAGA CCCTGTACCAGTTCCTGTTCCTGGCCACATTCATCAACTGCGGCAGGTTCAGCGACATCAAG AACGTGGACCCCAAGAGCTTCAAGCTGGTGCAGAACAAGTACCTGGGCGTGATCATTCAGTG CCTGGTGACCGAGACCAAGACAAGCGTGTCCAGGCACATCTACTTTTTCAGCGCCAGAGGC AGGATCGACCCCCTGGTGTACCTGGACGAGTTCCTGAGGAACAGCGAGCCCGTGCTGAAGA GAGTGAACAGGACCGGCAACAGCAGCAGCAACAAGCAGGAGTACCAGCTGCTGAAGGACAA |

| Fig 26 cont'd |
| --- |
| Vector ID (length between ITRs) & Sequence Between ITRs |
| CCTGGTGCGCAGCTACAACAAGGCCCTGAAGAAGAACGCCCCCTACCCCATCTTCGCTATCA AGAACGGCCCTAAGAGCCACATCGGCAGGCACCTGATGACCAGCTTTCTGAGCATGAAGGG CCTGACCGAGCTGACAAACGTGGTGGGCAACTGGAGCGACAAGAGGGCCTCCGCCGTGGC CAGGACCACCTACACCCACCAGATCACCGCCATCCCCGACCACTACTTCGCCCTGGTGTCCA GGTACTACGCCTACGACCCCATCAGCAAGGAGATGATCGCCCTGAAGGACGAGACCAACCC CATCGAGGAGTGGCAGCACATCGAGCAGCTGAAGGGCAGCGCCGAGGGCAGCATCAGATA CCCCGCCTGGAACGGCATCATCAGCCAGGAGGTGCTGGACTACCTGAGCAGCTACATCAAC AGGCGGATCTGAGAATTCGATATCAAGCTTATCGATAATCAACCTCTGGATTACAAAATTTGT GAAAGATTGACTGGTATTCTTAACTATGTTGCTCCTTTTACGCTATGTGGATACGCTGCTTTAA TGCCTTTGTATCATGCTATTGCTTCCCGTATGGCTTTCATTTTCTCCTCCTTGTATAAATCCTG GTTGCTGTCTCTTTATGAGGAGTTGTGGCCCGTTGTCAGGCAACGTGGCGTGGTGTGCACTG TGTTTGCTGACGCAACCCCCACTGGTTGGGGCATTGCCACCACCTGTCAGCTCCTTTCCGGG ACTTTCGCTTTCCCCCTCCCTATTGCCACGGCGGAACTCATCGCCGCCTGCCTTGCCCGCTG CTGGACAGGGGCTCGGCTGTTGGGCACTGACAATTCCGTGGTGTTGTCGGGGAAATCATCG TCCTTTCCTTGGCTGCTCGCCTATGTTGCCACCTGGATTCTGCGCGGGACGTCCTTCTGCTA CGTCCCTTCGGCCCTCAATCCAGCGGACCTTCCTTCCCGCGGCCTGCTGCCGGCTCTGCGG CCTCTTCCGCGTCTTCGCCTTCGCCCTCAGACGAGTCGGATCTCCCTTTGGGCCGCCTCCCC GCATCGATACCGAGCGCTGCTCGAGAGATCTACGGGTGGCATCCCTGTGACCCCTCCCCAG TGCCTCTCCTGGCCCTGGAAGTTGCCACTCCAGTGCCCACCAGCCTTGTCCTAATAAAATTA AGTTGCATCATTTTGTCTGACTAGGTGTCCTTCTATAATATTATGGGGTGGAGGGGGGTGGTA TGGAGCAAGGGGCAAGTTGGGAAGACAACCTGTAGGGCCTGCGGGGTCTATTGGGAACCAA GCTGGAGTGCAGTGGCACAATCTTGGCTCACTGCAATCTCCGCCTCCTGGGTTCAAGCGATT CTCCTGCCTCAGCCTCCCGAGTTGTTGGGATTCCAGGCATGCATGACCAGGCTCAGCTAATT TTTGTTTTTTTGGTAGAGACGGGGTTTCACCATATTGGCCAGGCTGGTCTCCAACTCCTAATC TCAGGTGATCTACCCACCTTGGCCTCCCAAATTGCTGGGATTACAGGCGTGAACCACTGCTC CCTTCCCTGTCCTTCTGATTTTGTAGGTAACCACGTGCGGACCGAGCGGCCGC (SEQ ID NO: 301) |
| 3020 (4161) GCGGCCGCACGCGTTCGGGAACATGGGGGGTCAAGTGAGAGAGCCAGGTGTCTCCAGCACT CAGCATGATATCTGACACAAATCAGACCCCTCACTTTTAACACTGTACCCTAAGACTTGGGGGC ACAGGCCAGGGACTTTCCGTTCTAGGCTCTCTGGCTCCTGCTTCTTGGATTCTGATCTCCGG TCTTATCGACTTCATTTCCAAATTAGAGGTTTTTTGGAACCCAGGGGGCTACCAGGCCAACCTG GAAGTCCGACTGCACATGCTGTATCCGTGACAGAGTTACAGAGAACAGGGACTGCCCTGAGT GGGACAGGCCGAAGAGGGACTGCCAGAGAGGTACAGACCCCACCCCCACCTTTGTAAGCCT GATTGCCTACCCAGGCCACCACAACTCCATCCAGCTCTGTCCCCGCCTTTGTTCCTGAGTCT CCAAGGCCCCCTTTCCTGCCAAACAAAGCCCCCAGCCACCCGACTGCCGCCCAACAGGCAC CTGGGGCCTCTGGGCCTGGGAATCAAAGCCTGTTTTGCAAAGGAGGCCCAGTGTTTGGAGA ACACCCATCCCCTGCTGCCCGGTCCTTCAAAGAACCGGCATTGTTCTGCGCTGAGAAGGCG CCTCTTGACGCGCTGGGCAGGGTCGGCTTGACGCTGGTGGACCTCTGATCTCAGGCCAGGC CCCCAGCCACTTGGGGGGAGGGTGGACTTAGGGGCCAAAGAGGGAGCAACCTGTCCTTGG GGCACTGTGGTCCTTCCTCATTCTCTGCCCACCCGAGTTCCCATCACCGAGTTCATTGAGAC CCAGGCTCTTCTACCTGGTGATCTGGACAAGGCAGGCCTCAGGAGGCACCAGGACAAGAGA TGAGATAGCGGGCAGGATTTTAGTGACCATAACAGGTACGTCAGAGACTGCAAACGTATTAG GCCTCAGTGGCATGTAACTGTGATTCTAGTACTTGGGATGCTGAGGCAGGAGAATCATGAGT TTGAAGTTAACCGGATCTTCAAGGCAAGACCCTGTCTCTAAATCATAGATCACAGGGGAGTGT GTGTTTGTGTGTGTGTGTGCGTGCGTGCGCGCATGCGCGTGTACACGTGCGTGTGCATA TGTATGCATGTTCTCATTTTACAGCTCACAGAGGCTAGAGAGGAAACTGGGCCCAGAGCCCG GTTCAAGCTGTGAACTGACAGGCCCCGTTGGCTCTTTTATTTGTTGAAGAAATATTTCCCAAT TACTTTCTTGTCCATTGTGGATTCCACTGCAAGCTAACATTAGTAAAGGCATTTAAATAAAAGT |

| Fig 26 cont'd |
|---|
| Vector ID (length between ITRs) & Sequence Between ITRs |
| CTGCCCAGACACAAACTAAGGCCACAGAACTGGCTGTGGTGCCCAGGCGGGTCGTGAGGAG CCCAAATAACACTCAAAAGCCACCTTTATTTGTCCTTCCCCTCTGCCAGTCACAGCATCATGA GCTTCTGGGGTGGTGTGTGTGTGGGGGGGGTGTTAGTCTCACTCCTGTGGCACTGCAGAAG TCTCTCAAGGCACAGAGAGAGGGCAAGCAATGTGTTCAAAGTCACCCAGAAACTGAGGTTAG ATTGGAGCGGAGAGCCTCATCTCAGGAGCTCATTCTGTCCGGTCCTCCCCTCAGATCACACT TCTGATCAAGTGGCACGGCAGACCTTGAGCTCGGGCTGGGCATAAAAGTCAGGGCAGAGCC ATCTATTGCTTACATTTGCTTCTGGCGTGGCCACCATGGCTCCTAAGAAGAAGAGGAAGGTG ATGAGCCAGTTCGACATCCTGTGCAAGACCCCCCCCAAGGTGCTGGTGCGGCAGTTCGTGG AGAGATTCGAGAGGCCCAGCGGCGAGAAGATCGCCAGCTGTGCCGCCGAGCTGACCTACCT GTGCTGGATGATCACCCACAACGGCACCGCCATCAAGAGGGCCACCTTCATGAGCTACAAC ACCATCATCAGCAACAGCCTGAGCTTCGACATCGTGAACAAGAGCCTGCAGTTCAAGTACAA GACCCAGAAGGCCACCATCCTGGAGGCCAGCCTGAAGAAGCTGATCCCCGCCTGGGAGTTC ACCATCATCCCTTACAACGGCCAGAAGCACCAGAGCGACATCACCGACATCGTGTCCAGCCT GCAGCTGCAGTTCGAGAGCAGCGAGGAGGCCGACAAGGGCAACAGCCACAGCAAGAAGAT GCTGAAGGCCCTGCTGTCCGAGGGCGAGAGCATCTGGGAGATCACCGAGAAGATCCTGAAC AGCTTCGAGTACACCAGCAGGTTCACCAAGACCAAGACCCTGTACCAGTTCCTGTTCCTGGC CACATTCATCAACTGCGGCAGGTTCAGCGACATCAAGAACGTGGACCCCAAGAGCTTCAAGC TGGTGCAGAACAAGTACCTGGGCGTGATCATTCAGTGCCTGGTGACCGAGACCAAGACAAG CGTGTCCAGGCACATCTACTTTTTCAGCGCCAGAGGCAGGATCGACCCCCTGGTGTACCTG GACGAGTTCCTGAGGAACAGCGAGCCCGTGCTGAAGAGAGTGAACAGGACCGGCAACAGCA GCAGCAACAAGCAGGAGTACCAGCTGCTGAAGGACAACCTGGTGCGCAGCTACAACAAGGC CCTGAAGAAGAACGCCCCCTACCCCATCTTCGCTATCAAGAACGGCCCTAAGAGCCACATCG GCAGGCACCTGATGACCAGCTTTCTGAGCATGAAGGGCCTGACCGAGCTGACAAACGTGGT GGGCAACTGGAGCGACAAGAGGGCCTCCGCCGTGGCCAGGACCACCTACACCCACCAGAT CACCGCCATCCCCGACCACTACTTCGCCCTGGTGTCCAGGTACTACGCCTACGACCCCATCA GCAAGGAGATGATCGCCCTGAAGGACGAGACCAACCCCATCGAGGAGTGGCAGCACATCGA GCAGCTGAAGGGCAGCGCCGAGGGCAGCATCAGATACCCCGCCTGGAACGGCATCATCAG CCAGGAGGTGCTGGACTACCTGAGCAGCTACATCAACAGGCGGATCTGAGAATTCGATATCA AGCTTATCGATAATCAACCTCTGGATTACAAAATTTGTGAAAGATTGACTGGTATTCTTAACTA TGTTGCTCCTTTTACGCTATGTGGATACGCTGCTTTAATGCCTTTGTATCATGCTATTGCTTCC CGTATGGCTTTCATTTTCTCCTCCTTGTATAAATCCTGGTTGCTGTCTCTTTATGAGGAGTTGT GGCCCGTTGTCAGGCAACGTGGCGTGGTGTGCACTGTGTTTGCTGACGCAACCCCCACTGG TTGGGGCATTGCCACCACCTGTCAGCTCCTTTCCGGGACTTTCGCTTTCCCCCTCCCTATTG CCACGGCGGAACTCATCGCCGCCTGCCTTGCCCGCTGCTGGACAGGGGCTCGGCTGTTGG GCACTGACAATTCCGTGGTGTTGTCGGGGAAATCATCGTCCTTTCCTTGGCTGCTCGCCTAT GTTGCCACCTGGATTCTGCGCGGGACGTCCTTCTGCTACGTCCCTTCGGCCCTCAATCCAGC GGACCTTCCTTCCCGCGGCCTGCTGCCGGCTCTGCGGCCTCTTCCGCGTCTTCGCCTTCGC CCTCAGACGAGTCGGATCTCCCTTTGGGCCGCCTCCCCGCATCGATACCGAGCGCTGCTCG AGAGATCTACGGGTGGCATCCCTGTGACCCCTCCCCAGTGCCTCTCCTGGCCCTGGAAGTT GCCACTCCAGTGCCCACCAGCCTTGTCCTAATAAAATTAAGTTGCATCATTTTGTCTGACTAG GTGTCCTTCTATAATATTATGGGGTGGAGGGGGGTGGTATGGAGCAAGGGGCAAGTTGGGA AGACAACCTGTAGGGCCTGCGGGGTCTATTGGGAACCAAGCTGGAGTGCAGTGGCACAATC TTGGCTCACTGCAATCTCCGCCTCCTGGGTTCAAGCGATTCTCCTGCCTCAGCCTCCCGAGT TGTTGGGATTCCAGGCATGCATGACCAGGCTCAGCTAATTTTTGTTTTTTTGGTAGAGACGGG GTTTCACCATATTGGCCAGGCTGGTCTCCAACTCCTAATCTCAGGTGATCTACCCACCTTGGC CTCCCAAATTGCTGGGATTACAGGCGTGAACCACTGCTCCCTTCCCTGTCCTTCTGATTTTGT AGGTAACCACGTGCGGACCGAGCGGCCGC (SEQ ID NO: 302) |
| 3021 (4001) |

| Fig 26 cont'd |
| :-- |
| Vector ID (length between ITRs) & Sequence Between ITRs |
| GCGGCCGCACGCGTAGAAACCTGTAATTTTCACATTCAAATACAATCCTGCGGACTTTTAATT |
| AACCTAACTGTTCCTACAATGCTTGCTGAGTACCATGCACCTGCAGGCCAGCACTGTGGCCT |
| TGCCTCCTGACGCACCTGCAGATCTCATCCTGATGCTCTACGATGAGTAGCTAAGGGAGAAA |
| ATATGCTTGCTGGCAGGATCCCCTTGGGGATAACTGTAGGCCGGTCCTATTTCATAAAATAG |
| CACACAGAAGTAGGAGACTATCGGTGAGTGGCAGGGAAAGCAGGCTTCACAGAGATGTTGA |
| GTAACTACAGGATGTTTAGTCTAGAGAAGAAAGATTATGGGGACTTTGATGGTTGTTTTCATC |
| ATTTCAAGAACTATTGTGTGACTACAAGGAGAATCTTGAGACCTACTGGGGCTATTCCAGTTG |
| GCCAATAGAGTGAGAATGTTAGAGAGAGATTCGTTTTGATGTCTTCGGAAGCCTGCTCTAAAG |
| GTATCTCTGCCTGTGAGCATTCCAGAAGCTGGCTGACCGCCCGGCCTATAAAGAAACAAGTT |
| TTTGCCAGTAATTCCAGTGAATGATCTTTGAGGACTCCTCAGACGTTACTCCTTTTGTTCTTGT |
| CCTCCAAAAGAAATGGAAAATAACAACACTTTCCCTGGGTCTTCCTGACGCTTTCAGAGTGAC |
| AAGAATGTTACCACAGGGCACTGTGTGTTCCCACCTTCCCCCACCTTCAATGGCCGGCCACT |
| GCAGCAACCTTGACTTAGTTAACTGAATCTGTTACAGTCAACAGACCTTGGTCCCAGTGACAT |
| TCTTCCTGCCCTGGTCACATACTGCTGAGCCTGTGAACCGTTACTAAGACCTCAACTGTGATT |
| GCTTTGGCCCACCCACTGGACATACAAATTCTAGTGCTGAACAGAACAGTCAAGAAAGAGGG |
| GGTATCTTGCCTCAAGGTGAGGTAAATGGTAGGAAGACGTTCACAGAGCAGTGCCCACGAG |
| AGGCAGTGCACACAAAGGTTCCACGTACAGCCCACAGCTTGACGTAGGAGTGTCCATTCTCT |
| GAGGGAATGTCAAAGGAAGGGAGGTGCCTCTCAGTGCCCTGCAGCTGCCCTAATCTTGACT |
| GTGGCTGCATCTCCCAGGCTTTGCAGTCTAGACTACCATCTCCTGAACACCTGCTTTGTTTTT |
| TGGTTTTGTTTTTTTTTTCGTAAAACTTTCCCAGACGTCATCACACAACTTGGAAAAGAGCGTG |
| TCTCCTGAGTTGCCATTTCTGTTGTCACGTTCTGACCAGCCAACGCTTGGAAAACAAACATAC |
| AGTTCCCGTTGGAAAGACTGTGGTAATATTTCTTCACAGAAGTTTGCTACCTCAGGAAACCAG |
| TTACCTCTTTGTTTCTTGCTGGATACATGGTTTTGGCACCATGTCAAACCTGCCTGAGGAATC |
| ACTGTTTACCTCAGAGGATGTAGCCTTGCTGCTTGAGCTCGGGCTGGGCATAAAAGTCAGGG |
| CAGAGCCATCTATTGCTTACATTTGCTTCTGGCGTGGCCACCATGGCTCCTAAGAAGAAGAG |
| GAAGGTGATGAGCCAGTTCGACATCCTGTGCAAGACCCCCCCCAAGGTGCTGGTGCGGCAG |
| TTCGTGGAGAGATTCGAGAGGCCCAGCGGCGAGAAGATCGCCAGCTGTGCCGCCGAGCTG |
| ACCTACCTGTGCTGGATGATCACCCACAACGGCACCGCCATCAAGAGGGCCACCTTCATGA |
| GCTACAACACCATCATCAGCAACAGCCTGAGCTTCGACATCGTGAACAAGAGCCTGCAGTTC |
| AAGTACAAGACCCAGAAGGCCACCATCCTGGAGGCCAGCCTGAAGAAGCTGATCCCCGCCT |
| GGGAGTTCACCATCATCCCTTACAACGGCCAGAAGCACCAGAGCGACATCACCGACATCGT |
| GTCCAGCCTGCAGCTGCAGTTCGAGAGCAGCGAGGAGGCCGACAAGGGCAACAGCCACAG |
| CAAGAAGATGCTGAAGGCCCTGCTGTCCGAGGGCGAGAGCATCTGGGAGATCACCGAGAAG |
| ATCCTGAACAGCTTCGAGTACACCAGCAGGTTCACCAAGACCAAGACCCTGTACCAGTTCCT |
| GTTCCTGGCCACATTCATCAACTGCGGCAGGTTCAGCGACATCAAGAACGTGGACCCCAAGA |
| GCTTCAAGCTGGTGCAGAACAAGTACCTGGGCGTGATCATTCAGTGCCTGGTGACCGAGAC |
| CAAGACAAGCGTGTCCAGGCACATCTACTTTTTCAGCGCCAGAGGCAGGATCGACCCCCTG |
| GTGTACCTGGACGAGTTCCTGAGGAACAGCGAGCCCGTGCTGAAGAGAGTGAACAGGACCG |
| GCAACAGCAGCAGCAACAAGCAGGAGTACCAGCTGCTGAAGGACAACCTGGTGCGCAGCTA |
| CAACAAGGCCCTGAAGAAGAACGCCCCCTACCCCATCTTCGCTATCAAGAACGGCCCTAAGA |
| GCCACATCGGCAGGCACCTGATGACCAGCTTTCTGAGCATGAAGGGCCTGACCGAGCTGAC |
| AAACGTGGTGGGCAACTGGAGCGACAAGAGGGCCTCCGCCGTGGCCAGGACCACCTACAC |
| CCACCAGATCACCGCCATCCCCGACCACTACTTCGCCCTGGTGTCCAGGTACTACGCCTACG |
| ACCCCATCAGCAAGGAGATGATCGCCCTGAAGGACGAGACCAACCCCATCGAGGAGTGGCA |
| GCACATCGAGCAGCTGAAGGGCAGCGCCGAGGGCAGCATCAGATACCCCGCCTGGAACGG |
| CATCATCAGCCAGGAGGTGCTGGACTACCTGAGCAGCTACATCAACAGGCGGATCTGAGAAT |
| TCGATATCAAGCTTATCGATAATCAACCTCTGGATTACAAAATTTGTGAAAGATTGACTGGTAT |
| TCTTAACTATGTTGCTCCTTTTACGCTATGTGGATACGCTGCTTTAATGCCTTTGTATCATGCT |
| ATTGCTTCCCGTATGGCTTTCATTTTCTCCTCCTTGTATAAATCCTGGTTGCTGTCTCTTTATG |

| Fig 26 cont'd |
| --- |
| Vector ID (length between ITRs) & Sequence Between ITRs |
| AGGAGTTGTGGCCCGTTGTCAGGCAACGTGGCGTGGTGTGCACTGTGTTTGCTGACGCAAC CCCCACTGGTTGGGGCATTGCCACCACCTGTCAGCTCCTTTCCGGGACTTTCGCTTTCCCCC TCCCTATTGCCACGGCGGAACTCATCGCCGCCTGCCTTGCCCGCTGCTGGACAGGGGCTCG GCTGTTGGGCACTGACAATTCCGTGGTGTTGTCGGGGAAATCATCGTCCTTTCCTTGGCTGC TCGCCTATGTTGCCACCTGGATTCTGCGCGGGACGTCCTTCTGCTACGTCCCTTCGGCCCTC AATCCAGCGGACCTTCCTTCCCGCGGCCTGCTGCCGGCTCTGCGGCCTCTTCCGCGTCTTC GCCTTCGCCCTCAGACGAGTCGGATCTCCCTTTGGGCCGCCTCCCCGCATCGATACCGAGC GCTGCTCGAGAGATCTACGGGTGGCATCCCTGTGACCCCTCCCCAGTGCCTCTCCTGGCCC TGGAAGTTGCCACTCCAGTGCCCACCAGCCTTGTCCTAATAAAATTAAGTTGCATCATTTTGT CTGACTAGGTGTCCTTCTATAATATTATGGGGTGGAGGGGGGTGGTATGGAGCAAGGGGCA AGTTGGGAAGACAACCTGTAGGGCCTGCGGGGTCTATTGGGAACCAAGCTGGAGTGCAGTG GCACAATCTTGGCTCACTGCAATCTCCGCCTCCTGGGTTCAAGCGATTCTCCTGCCTCAGCC TCCCGAGTTGTTGGGATTCCAGGCATGCATGACCAGGCTCAGCTAATTTTTGTTTTTTTGGTA GAGACGGGGTTTCACCATATTGGCCAGGCTGGTCTCCAACTCCTAATCTCAGGTGATCTACC CACCTTGGCCTCCCAAATTGCTGGGATTACAGGCGTGAACCACTGCTCCCTTCCCTGTCCTT CTGATTTTGTAGGTAACCACGTGCGGACCGAGCGGCCGC (SEQ ID NO: 303) |
| 3022 (3530) GCGGCCGCACGCGTCACCTCATTAACTCCCAGGCACTAAGCTTAGATCACCTTTCTGTGGTG ACCTTTTTAGCTCCCTTCCCTTTCTCCAAGTTATCTTCCAGGGGAAGGAGCTAGGCCTGGTCT TAGGGGACAGGAGTGAGCCCCTTGGGGACCAGGGCTGGGCCCTTTGGCTGCCATCTGGCA GTACAGTCTGGAGCCTCCCAAGCCCCTGCTGTGAGGCCTCTGGGGTGAAAGTGTCTGTCAG GCTGTGAGGTGGGTCTGTGCCCAGTTCACTCTGACTATCCAGAGACTTGGGCTGTTGGCCTG GCTCGGAGAACGGGTTCTGCTGCCCTGGGCACAATGCAGAGCAAAGAGGAAAGAAACCTTT TCCAAAGCAGAGGCCAGGAGGAAGCACACAGAGGCCTCTTTGCTTTGGAACCGAAGCCTTT CAGGTCTGTTTTCTTTAAATATCCTGCTACAGGAAAGAGAAGCCCAAATCCAGACATTCCTAA AACATTCAGGTGGCTTTAAAGCAGCAGTTTGTTTGATCTTCACCCCACCCTGTTTCTGCTCAC TGGGGTCTCTGGGACCTACTCCTGCCTGGAGCTTGGTTGGAAGGTCCACACCCTTCCAAGTT CACTCACATAGCCGATGTACCGATGGGGCCTGAGACCTGATTGGAACTTGCTTTTTCTACTTT AGTCTGTTTTTGTTTTCGTCTGCCGTGCTGAAGATCAAACTCTTGGCCGTGTGCATCCTAGGC GCTCACTACCACTGAGTCTCAGCCCCTGCCCAGGTTTTGTTTGGTTTGGTTTGAAGTCACTTT TCTTTGATCCCCAGCTGTAATGGCATGGCTGACCACACCCTTTTCCTGGAAAGTCTTTCCCTT GACCTCTGGGGTCAGACACACAATGACTTCTGACTCAGTGCTCTGCCTCACTACTGATCACT AGACCTAAAGTCCCATCATGAGGCACCTGAGGGTCTCCATCACTTCACTGGTCTTTAACCCA GAGGACTGAGCTCGGGCTGGGCATAAAAGTCAGGGCAGAGCCATCTATTGCTTACATTTGCT TCTGGCGTGGCCACCATGGCTCCTAAGAAGAAGAGGAAGGTGATGAGCCAGTTCGACATCC TGTGCAAGACCCCCCCCAAGGTGCTGGTGCGGCAGTTCGTGGAGAGATTCGAGAGGCCCAG CGGCGAGAAGATCGCCAGCTGTGCCGCCGAGCTGACCTACCTGTGCTGGATGATCACCCAC AACGGCACCGCCATCAAGAGGGCCACCTTCATGAGCTACAACACCATCATCAGCAACAGCCT GAGCTTCGACATCGTGAACAAGAGCCTGCAGTTCAAGTACAAGACCCAGAAGGCCACCATCC TGGAGGCCAGCCTGAAGAAGCTGATCCCCGCCTGGGAGTTCACCATCATCCCTTACAACGG CCAGAAGCACCAGAGCGACATCACCGACATCGTGTCCAGCCTGCAGCTGCAGTTCGAGAGC AGCGAGGAGGCCGACAAGGGCAACAGCCACAGCAAGAAGATGCTGAAGGCCCTGCTGTCC GAGGGCGAGAGCATCTGGGAGATCACCGAGAAGATCCTGAACAGCTTCGAGTACACCAGCA GGTTCACCAAGACCAAGACCCTGTACCAGTTCCTGTTCCTGGCCACATTCATCAACTGCGGC AGGTTCAGCGACATCAAGAACGTGGACCCCAAGAGCTTCAAGCTGGTGCAGAACAAGTACCT GGGCGTGATCATTCAGTGCCTGGTGACCGAGACCAAGACAAGCGTGTCCAGGCACATCTAC TTTTTCAGCGCCAGAGGCAGGATCGACCCCCTGGTGTACCTGGACGAGTTCCTGAGGAACA GCGAGCCCGTGCTGAAGAGAGTGAACAGGACCGGCAACAGCAGCAGCAACAAGCAGGAGT ACCAGCTGCTGAAGGACAACCTGGTGCGCAGCTACAACAAGGCCCTGAAGAAGAACGCCCC |

| Fig 26 cont'd |
|---|
| Vector ID (length between ITRs) & Sequence Between ITRs |
| CTACCCCATCTTCGCTATCAAGAACGGCCCTAAGAGCCACATCGGCAGGCACCTGATGACCA<br>GCTTTCTGAGCATGAAGGGCCTGACCGAGCTGACAAACGTGGTGGGCAACTGGAGCGACAA<br>GAGGGCCTCCGCCGTGGCCAGGACCACCTACACCCACCAGATCACCGCCATCCCCGACCAC<br>TACTTCGCCCTGGTGTCCAGGTACTACGCCTACGACCCCATCAGCAAGGAGATGATCGCCCT<br>GAAGGACGAGACCAACCCCATCGAGGAGTGGCAGCACATCGAGCAGCTGAAGGGCAGCGC<br>CGAGGGCAGCATCAGATACCCCGCCTGGAACGGCATCATCAGCCAGGAGGTGCTGGACTAC<br>CTGAGCAGCTACATCAACAGGCGGATCTGAGAATTCGATATCAAGCTTATCGATAATCAACCT<br>CTGGATTACAAAATTTGTGAAAGATTGACTGGTATTCTTAACTATGTTGCTCCTTTTACGCTAT<br>GTGGATACGCTGCTTTAATGCCTTTGTATCATGCTATTGCTTCCCGTATGGCTTTCATTTTCTC<br>CTCCTTGTATAAATCCTGGTTGCTGTCTCTTTATGAGGAGTTGTGGCCCGTTGTCAGGCAACG<br>TGGCGTGGTGTGCACTGTGTTTGCTGACGCAACCCCCACTGGTTGGGGCATTGCCACCACC<br>TGTCAGCTCCTTTCCGGGACTTTCGCTTTCCCCCTCCCTATTGCCACGGCGGAACTCATCGC<br>CGCCTGCCTTGCCCGCTGCTGGACAGGGGCTCGGCTGTTGGGCACTGACAATTCCGTGGTG<br>TTGTCGGGGAAATCATCGTCCTTTCCTTGGCTGCTCGCCTATGTTGCCACCTGGATTCTGCG<br>CGGGACGTCCTTCTGCTACGTCCCTTCGGCCCTCAATCCAGCGGACCTTCCTTCCCGCGGC<br>CTGCTGCCGGCTCTGCGGCCTCTTCCGCGTCTTCGCCTTCGCCCTCAGACGAGTCGGATCT<br>CCCTTTGGGCCGCCTCCCCGCATCGATACCGAGCGCTGCTCGAGAGATCTACGGGTGGCAT<br>CCCTGTGACCCCTCCCCAGTGCCTCTCCTGGCCCTGGAAGTTGCCACTCCAGTGCCCACCA<br>GCCTTGTCCTAATAAAATTAAGTTGCATCATTTTGTCTGACTAGGTGTCCTTCTATAATATTAT<br>GGGGTGGAGGGGGGTGGTATGGAGCAAGGGGCAAGTTGGGAAGACAACCTGTAGGGCCTG<br>CGGGGTCTATTGGGAACCAAGCTGGAGTGCAGTGGCACAATCTTGGCTCACTGCAATCTCC<br>GCCTCCTGGGTTCAAGCGATTCTCCTGCCTCAGCCTCCCGAGTTGTTGGGATTCCAGGCATG<br>CATGACCAGGCTCAGCTAATTTTTGTTTTTTTGGTAGAGACGGGGTTTCACCATATTGGCCAG<br>GCTGGTCTCCAACTCCTAATCTCAGGTGATCTACCCACCTTGGCCTCCCAAATTGCTGGGATT<br>ACAGGCGTGAACCACTGCTCCCTTCCCTGTCCTTCTGATTTTGTAGGTAACCACGTGCGGAC<br>CGAGCGGCCGC (SEQ ID NO: 304) |
| 3023 (3226)<br>GCGGCCGCACGCGTGGTAATGTAGCCCATATGTTTACAGGGTAGGCTCGATAAGGACGATA<br>GATACATATACATCTACTGTGTTACCTGGTTCTAGGACCCACTTCAGTATAGGAACAAGACTA<br>AACAGAAATTGGGCCGCATCCCATTGCACACTTCCTTAGCTCTCATCTCCTCTACTCCGAGAC<br>ACGGAGTGCTTTCCACAGCAACCACGTAGGTGGGAGCTGGAGTCATTTGAGGTCTTAGGGC<br>CAAGGCGGTGCTTCGCCTCAAGGCTATGCAGTTTCCAAGTCCAGACATCTGGATTTTAGGGT<br>CTATAATGGAAACTCAGTCGGGGTCATGGCCTCTCCTGGGAAGAGTCTCCAGAATTTTGTAA<br>CAGGACTTTCTCTTAGAGATCAGTGTGTTGTGGCGACATGGGACAATGTCCAGGCTTCTGCT<br>GCCAGATGTTGGGATTGTTGTGATCCATGGCTTTCTCCCAAACCAAATCATCCGCCCCGGAG<br>TTTCCATAAACCTTTCTCAAGGGGTGTGAGCTACCAGAAAGATCATGGTGTGTCCTGGGTGC<br>TGGCCTTTGAGAACCCACCTAGCCCTCTCCAGCCTCTCCCTCAGGCTGGAGGCTGGAGGAA<br>GATTATTTTTGTACTTGAGTAACTGCGTCAACCTTAGGAGTAATAACTTGGCTATGACTCTATT<br>TATTTATTCACAAAGAGCTCGGGCTGGGCATAAAAGTCAGGGCAGAGCCATCTATTGCTTACA<br>TTTGCTTCTGGCGTGGCCACCATGGCTCCTAAGAAGAAGAGGAAGGTGATGAGCCAGTTCGA<br>CATCCTGTGCAAGACCCCCCCAAGGTGCTGGTGCGGCAGTTCGTGGAGAGATTCGAGAGG<br>CCCAGCGGCGAGAAGATCGCCAGCTGTGCCGCCGAGCTGACCTACCTGTGCTGGATGATCA<br>CCCACAACGGCACCGCCATCAAGAGGGCCACCTTCATGAGCTACAACACCATCATCAGCAAC<br>AGCCTGAGCTTCGACATCGTGAACAAGAGCCTGCAGTTCAAGTACAAGACCCAGAAGGCCAC<br>CATCCTGGAGGCCAGCCTGAAGAAGCTGATCCCCGCCTGGGAGTTCACCATCATCCCTTACA<br>ACGGCCAGAAGCACCAGAGCGACATCACCGACATCGTGTCCAGCCTGCAGCTGCAGTTCGA<br>GAGCAGCGAGGAGGCCGACAAGGGCAACAGCCACAGCAAGAAGATGCTGAAGGCCCTGCT<br>GTCCGAGGGCGAGAGCATCTGGGAGATCACCGAGAAGATCCTGAACAGCTTCGAGTACACC<br>AGCAGGTTCACCAAGACCAAGACCCTGTACCAGTTCCTGTTCCTGGCCACATTCATCAACTG |

| Fig 26 cont'd |
|---|
| Vector ID (length between ITRs) & Sequence Between ITRs |
| CGGCAGGTTCAGCGACATCAAGAACGTGGACCCCAAGAGCTTCAAGCTGGTGCAGAACAAG<br>TACCTGGGCGTGATCATTCAGTGCCTGGTGACCGAGACCAAGACAAGCGTGTCCAGGCACA<br>TCTACTTTTTCAGCGCCAGAGGCAGGATCGACCCCCTGGTGTACCTGGACGAGTTCCTGAGG<br>AACAGCGAGCCCGTGCTGAAGAGAGTGAACAGGACCGGCAACAGCAGCAGCAACAAGCAG<br>GAGTACCAGCTGCTGAAGGACAACCTGGTGCGCAGCTACAACAAGGCCCTGAAGAAGAACG<br>CCCCCTACCCCATCTTCGCTATCAAGAACGGCCCTAAGAGCCACATCGGCAGGCACCTGATG<br>ACCAGCTTTCTGAGCATGAAGGGCCTGACCGAGCTGACAAACGTGGTGGGCAACTGGAGCG<br>ACAAGAGGGCCTCCGCCGTGGCCAGGACCACCTACACCCACCAGATCACCGCCATCCCCGA<br>CCACTACTTCGCCCTGGTGTCCAGGTACTACGCCTACGACCCCATCAGCAAGGAGATGATCG<br>CCCTGAAGGACGAGACCAACCCCATCGAGGAGTGGCAGCACATCGAGCAGCTGAAGGGCA<br>GCGCCGAGGGCAGCATCAGATACCCCGCCTGGAACGGCATCATCAGCCAGGAGGTGCTGG<br>ACTACCTGAGCAGCTACATCAACAGGCGGATCTGAGAATTCGATATCAAGCTTATCGATAATC<br>AACCTCTGGATTACAAAATTTGTGAAAGATTGACTGGTATTCTTAACTATGTTGCTCCTTTTAC<br>GCTATGTGGATACGCTGCTTTAATGCCTTTGTATCATGCTATTGCTTCCCGTATGGCTTTCATT<br>TTCTCCTCCTTGTATAAATCCTGGTTGCTGTCTCTTTATGAGGAGTTGTGGCCCGTTGTCAGG<br>CAACGTGGCGTGGTGTGCACTGTGTTTGCTGACGCAACCCCCACTGGTTGGGGCATTGCCA<br>CCACCTGTCAGCTCCTTTCCGGGACTTTCGCTTTCCCCCTCCCTATTGCCACGGCGGAACTC<br>ATCGCCGCCTGCCTTGCCCGCTGCTGGACAGGGGCTCGGCTGTTGGGCACTGACAATTCCG<br>TGGTGTTGTCGGGGAAATCATCGTCCTTTCCTTGGCTGCTCGCCTATGTTGCCACCTGGATT<br>CTGCGCGGGACGTCCTTCTGCTACGTCCCTTCGGCCCTCAATCCAGCGGACCTTCCTTCCC<br>GCGGCCTGCTGCCGGCTCTGCGGCCTCTTCCGCGTCTTCGCCTTCGCCCTCAGACGAGTCG<br>GATCTCCCTTTGGGCCGCCTCCCCGCATCGATACCGAGCGCTGCTCGAGAGATCTACGGGT<br>GGCATCCCTGTGACCCCTCCCCAGTGCCTCTCCTGGCCCTGGAAGTTGCCACTCCAGTGCC<br>CACCAGCCTTGTCCTAATAAAATTAAGTTGCATCATTTTGTCTGACTAGGTGTCCTTCTATAAT<br>ATTATGGGGTGGAGGGGGGTGGTATGGAGCAAGGGGCAAGTTGGGAAGACAACCTGTAGG<br>GCCTGCGGGGTCTATTGGGAACCAAGCTGGAGTGCAGTGGCACAATCTTGGCTCACTGCAA<br>TCTCCGCCTCCTGGGTTCAAGCGATTCTCCTGCCTCAGCCTCCCGAGTTGTTGGGATTCCAG<br>GCATGCATGACCAGGCTCAGCTAATTTTTGTTTTTTTGGTAGAGACGGGGTTTCACCATATTG<br>GCCAGGCTGGTCTCCAACTCCTAATCTCAGGTGATCTACCCACCTTGGCCTCCCAAATTGCT<br>GGGATTACAGGCGTGAACCACTGCTCCCTTCCCTGTCCTTCTGATTTTGTAGGTAACCACGT<br>GCGGACCGAGCGGCCGC (SEQ ID NO: 305) |
| 3024 (3266)<br>GCGGCCGCACGCGTCCCCAGGAAAGACGTCACAAAGTCTGTGAATACCACATGGAATGTGT<br>TTAGCGTGTTCCTTGTTGACCCTCTGAGATTCTTGAAGAGCATCCCCCAGTGATCTAAGTTCC<br>TCACAGCGGGTCCCACCTCCTGGAGGTTCCAGGACCTTCCAGTACATCCTGGGGACAATGT<br>CTTTAGCAGGGAGGTCTTGGGGGGGACAACTAAGGTCTCAATGATAACACCACCCTTGGATTA<br>AATACGCAACTAGCCCACCTGGGCTTGGTCACTGAGCCCTGCCCCAGTCAAGACAAAGGACT<br>AATGTCTCCCAGAGGGCTTCAGGAGCAGCCCGCGAAGACGGACAGGCAGGGCGGCAAAGC<br>GAGCACAGCGCCTCACATCCGGAAAATTATTAGACTTGTATACTCTAGCAAATTCTTTCCAGT<br>CCACTTTTAGCCTGGCACTGCTCACACCACTGACTTTCAGGCTTGAGCAGGGACATGAGCCA<br>ATGAAAACGAACTGTAACTCATGGACGCAGGGATAAGAGCTCTTTGGGGGCGGAGCCAATG<br>AAAAGGAACTGTAATTCCTGGATGGAGGGATGGGAGCTCTCTGGGGGGCGCACCGCTGTGA<br>TGCACACGTGGTGAGTGCCTGGGAATTGGTTTCACATGCATTTTGCCTGTGTGAAATACAGA<br>CGGTGAGGTTTTAGGTAGCAGAACACAGCTTTCTCTCACTTCCTGGTTCATTCACCGAAGAG<br>CTCGGGCTGGGCATAAAAGTCAGGGCAGAGCCATCTATTGCTTACATTTGCTTCTGGCGTGG<br>CCACCATGGCTCCTAAGAAGAAGAGGAAGGTGATGAGCCAGTTCGACATCCTGTGCAAGAC<br>CCCCCCCAAGGTGCTGGTGCGGCAGTTCGTGGAGAGATTCGAGAGGCCCAGCGGCGAGAA<br>GATCGCCAGCTGTGCCGCCGAGCTGACCTACCTGTGCTGGATGATCACCCACAACGGCACC<br>GCCATCAAGAGGGCCACCTTCATGAGCTACAACACCATCATCAGCAACAGCCTGAGCTTCGA |

| Fig 26 cont'd |
|---|
| Vector ID (length between ITRs) & Sequence Between ITRs |
| CATCGTGAACAAGAGCCTGCAGTTCAAGTACAAGACCCAGAAGGCCACCATCCTGGAGGCC AGCCTGAAGAAGCTGATCCCCGCCTGGGAGTTCACCATCATCCCTTACAACGGCCAGAAGCA CCAGAGCGACATCACCGACATCGTGTCCAGCCTGCAGCTGCAGTTCGAGAGCAGCGAGGAG GCCGACAAGGGCAACAGCCACAGCAAGAAGATGCTGAAGGCCCTGCTGTCCGAGGGCGAG AGCATCTGGGAGATCACCGAGAAGATCCTGAACAGCTTCGAGTACACCAGCAGGTTCACCAA GACCAAGACCCTGTACCAGTTCCTGTTCCTGGCCACATTCATCAACTGCGGCAGGTTCAGCG ACATCAAGAACGTGGACCCCAAGAGCTTCAAGCTGGTGCAGAACAAGTACCTGGGCGTGAT CATTCAGTGCCTGGTGACCGAGACCAAGACAAGCGTGTCCAGGCACATCTACTTTTTCAGCG CCAGAGGCAGGATCGACCCCCTGGTGTACCTGGACGAGTTCCTGAGGAACAGCGAGCCCGT GCTGAAGAGAGTGAACAGGACCGGCAACAGCAGCAGCAACAAGCAGGAGTACCAGCTGCTG AAGGACAACCTGGTGCGCAGCTACAACAAGGCCCTGAAGAAGAACGCCCCCTACCCCATCT TCGCTATCAAGAACGGCCCTAAGAGCCACATCGGCAGGCACCTGATGACCAGCTTTCTGAGC ATGAAGGGCCTGACCGAGCTGACAAACGTGGTGGGCAACTGGAGCGACAAGAGGGCCTCC GCCGTGGCCAGGACCACCTACACCCACCAGATCACCGCCATCCCCGACCACTACTTCGCCC TGGTGTCCAGGTACTACGCCTACGACCCCATCAGCAAGGAGATGATCGCCCTGAAGGACGA GACCAACCCCATCGAGGAGTGGCAGCACATCGAGCAGCTGAAGGGCAGCGCCGAGGGCAG CATCAGATACCCCGCCTGGAACGGCATCATCAGCCAGGAGGTGCTGGACTACCTGAGCAGC TACATCAACAGGCGGATCTGAGAATTCGATATCAAGCTTATCGATAATCAACCTCTGGATTAC AAAATTTGTGAAAGATTGACTGGTATTCTTAACTATGTTGCTCCTTTTACGCTATGTGGATACG CTGCTTTAATGCCTTTGTATCATGCTATTGCTTCCCGTATGGCTTTCATTTTCTCCTCCTTGTA TAAATCCTGGTTGCTGTCTCTTTATGAGGAGTTGTGGCCCGTTGTCAGGCAACGTGGCGTGG TGTGCACTGTGTTTGCTGACGCAACCCCCACTGGTTGGGGCATTGCCACCACCTGTCAGCTC CTTTCCGGGACTTTCGCTTTCCCCCTCCCTATTGCCACGGCGGAACTCATCGCCGCCTGCCT TGCCCGCTGCTGGACAGGGGCTCGGCTGTTGGGCACTGACAATTCCGTGGTGTTGTCGGGG AAATCATCGTCCTTTCCTTGGCTGCTCGCCTATGTTGCCACCTGGATTCTGCGCGGGACGTC CTTCTGCTACGTCCCTTCGGCCCTCAATCCAGCGGACCTTCCTTCCCGCGGCCTGCTGCCG GCTCTGCGGCCTCTTCCGCGTCTTCGCCTTCGCCCTCAGACGAGTCGGATCTCCCTTTGGG CCGCCTCCCCGCATCGATACCGAGCGCTGCTCGAGAGATCTACGGGTGGCATCCCTGTGAC CCCTCCCCAGTGCCTCTCCTGGCCCTGGAAGTTGCCACTCCAGTGCCCACCAGCCTTGTCCT AATAAAATTAAGTTGCATCATTTTGTCTGACTAGGTGTCCTTCTATAATATTATGGGGTGGAGG GGGGTGGTATGGAGCAAGGGGCAAGTTGGGAAGACAACCTGTAGGGCCTGCGGGGTCTATT GGGAACCAAGCTGGAGTGCAGTGGCACAATCTTGGCTCACTGCAATCTCCGCCTCCTGGGT TCAAGCGATTCTCCTGCCTCAGCCTCCCGAGTTGTTGGGATTCCAGGCATGCATGACCAGGC TCAGCTAATTTTTGTTTTTTTGGTAGAGACGGGGTTTCACCATATTGGCCAGGCTGGTCTCCA ACTCCTAATCTCAGGTGATCTACCCACCTTGGCCTCCCAAATTGCTGGGATTACAGGCGTGA ACCACTGCTCCCTTCCCTGTCCTTCTGATTTTGTAGGTAACCACGTGCGGACCGAGCGGCCG C (SEQ ID NO: 306) |
| 3025 (2916) GCGGCCGCACGCGTCCCCACAACCAGAAGCATGTCTCCCAGAGGCCAGGACGCATCGTGG AGCTGGAGTCCTGGAGCCAGAATGAAGGAGAGTCCCCAAGCCTGGGATGTCACATGGCCCA GCCTTCAAGCAAACATGTAACACCCACTTGGGACTTAGGAATCATTAACTGGCTCTGTGGCTT GTAAAATAAATAAATAAATAAATAAACCTTCCTATTTGTTTAACCTCTGGAGTTTTCAGTTTCCT CTTCTCAATGAAAATGAGCCAACCTTCCCACTTTTTTTTTTTTAAGCAGGGGACATTGAAACAT ACCGTTCTTCCTCTCTGCACCAAAGAAGATCAGGAAGTGACTTTTTCCCATTATGAAATCTCA GTGATGGCCCAGAGCTCGGGCTGGGCATAAAAGTCAGGGCAGAGCCATCTATTGCTTACATT TGCTTCTGGCGTGGCCACCATGGCTCCTAAGAAGAAGAGGAAGGTGATGAGCCAGTTCGAC ATCCTGTGCAAGACCCCCCCCAAGGTGCTGGTGCGGCAGTTCGTGGAGAGATTCGAGAGGC CCAGCGGCGAGAAGATCGCCAGCTGTGCCGCCGAGCTGACCTACCTGTGCTGGATGATCAC CCACAACGGCACCGCCATCAAGAGGGCCACCTTCATGAGCTACAACACCATCATCAGCAACA |

| Fig 26 cont'd |
|---|
| Vector ID (length between ITRs) & Sequence Between ITRs |
| GCCTGAGCTTCGACATCGTGAACAAGAGCCTGCAGTTCAAGTACAAGACCCAGAAGGCCAC<br>CATCCTGGAGGCCAGCCTGAAGAAGCTGATCCCCGCCTGGGAGTTCACCATCATCCCTTACA<br>ACGGCCAGAAGCACCAGAGCGACATCACCGACATCGTGTCCAGCCTGCAGCTGCAGTTCGA<br>GAGCAGCGAGGAGGCCGACAAGGGCAACAGCCACAGCAAGAAGATGCTGAAGGCCCTGCT<br>GTCCGAGGGCGAGAGCATCTGGGAGATCACCGAGAAGATCCTGAACAGCTTCGAGTACACC<br>AGCAGGTTCACCAAGACCAAGACCCTGTACCAGTTCCTGTTCCTGGCCACATTCATCAACTG<br>CGGCAGGTTCAGCGACATCAAGAACGTGGACCCCAAGAGCTTCAAGCTGGTGCAGAACAAG<br>TACCTGGGCGTGATCATTCAGTGCCTGGTGACCGAGACCAAGACAAGCGTGTCCAGGCACA<br>TCTACTTTTTCAGCGCCAGAGGCAGGATCGACCCCCTGGTGTACCTGGACGAGTTCCTGAGG<br>AACAGCGAGCCCGTGCTGAAGAGAGTGAACAGGACCGGCAACAGCAGCAGCAACAAGCAG<br>GAGTACCAGCTGCTGAAGGACAACCTGGTGCGCAGCTACAACAAGGCCCTGAAGAAGAACG<br>CCCCCTACCCCATCTTCGCTATCAAGAACGGCCCTAAGAGCCACATCGGCAGGCACCTGATG<br>ACCAGCTTTCTGAGCATGAAGGGCCTGACCGAGCTGACAAACGTGGTGGGCAACTGGAGCG<br>ACAAGAGGGCCTCCGCCGTGGCCAGGACCACCTACACCCACCAGATCACCGCCATCCCCGA<br>CCACTACTTCGCCCTGGTGTCCAGGTACTACGCCTACGACCCCATCAGCAAGGAGATGATCG<br>CCCTGAAGGACGAGACCAACCCCATCGAGGAGTGGCAGCACATCGAGCAGCTGAAGGGCA<br>GCGCCGAGGGCAGCATCAGATACCCCGCCTGGAACGGCATCATCAGCCAGGAGGTGCTGG<br>ACTACCTGAGCAGCTACATCAACAGGCGGATCTGAGAATTCGATATCAAGCTTATCGATAATC<br>AACCTCTGGATTACAAAATTTGTGAAAGATTGACTGGTATTCTTAACTATGTTGCTCCTTTTAC<br>GCTATGTGGATACGCTGCTTTAATGCCTTTGTATCATGCTATTGCTTCCCGTATGGCTTTCATT<br>TTCTCCTCCTTGTATAAATCCTGGTTGCTGTCTCTTTATGAGGAGTTGTGGCCCGTTGTCAGG<br>CAACGTGGCGTGGTGTGCACTGTGTTTGCTGACGCAACCCCCACTGGTTGGGGCATTGCCA<br>CCACCTGTCAGCTCCTTTCCGGGACTTTCGCTTTCCCCCTCCCTATTGCCACGGCGGAACTC<br>ATCGCCGCCTGCCTTGCCCGCTGCTGGACAGGGGCTCGGCTGTTGGGCACTGACAATTCCG<br>TGGTGTTGTCGGGGAAATCATCGTCCTTTCCTTGGCTGCTCGCCTATGTTGCCACCTGGATT<br>CTGCGCGGGACGTCCTTCTGCTACGTCCCTTCGGCCCTCAATCCAGCGGACCTTCCTTCCC<br>GCGGCCTGCTGCCGGCTCTGCGGCCTCTTCCGCGTCTTCGCCTTCGCCCTCAGACGAGTCG<br>GATCTCCCTTTGGGCCGCCTCCCCGCATCGATACCGAGCGCTGCTCGAGAGATCTACGGGT<br>GGCATCCCTGTGACCCCTCCCCAGTGCCTCTCCTGGCCCTGGAAGTTGCCACTCCAGTGCC<br>CACCAGCCTTGTCCTAATAAAATTAAGTTGCATCATTTTGTCTGACTAGGTGTCCTTCTATAAT<br>ATTATGGGGTGGAGGGGGGTGGTATGGAGCAAGGGGCAAGTTGGGAAGACAACCTGTAGG<br>GCCTGCGGGGTCTATTGGGAACCAAGCTGGAGTGCAGTGGCACAATCTTGGCTCACTGCAA<br>TCTCCGCCTCCTGGGTTCAAGCGATTCTCCTGCCTCAGCCTCCCGAGTTGTTGGGATTCCAG<br>GCATGCATGACCAGGCTCAGCTAATTTTTGTTTTTTTGGTAGAGACGGGGTTTCACCATATTG<br>GCCAGGCTGGTCTCCAACTCCTAATCTCAGGTGATCTACCCACCTTGGCCTCCCAAATTGCT<br>GGGATTACAGGCGTGAACCACTGCTCCCTTCCCTGTCCTTCTGATTTTGTAGGTAACCACGT<br>GCGGACCGAGCGGCCGC (SEQ ID NO: 307) |
| 3026 (2872)<br>GCGGCCGCACGCGTGTTGCGTCTGTCAGGGACAGCTCTGGATCCCCAGAGCCAGATCGTGC<br>TCTGTAGCTCCCTTAGGAGCAACTATCAACAGATCCATGACCAAGAGGGCCCCAAGATTCAA<br>AGACTGTTCCAGTCTACTCTGGATTTTTCCAGCTGTTTTTCTTGGCCAGAGGATCACACCCAT<br>CGGGATGCAAACCGAGAGCAGGAAGCAAGCGGAACAGTAAAGTCAGATGAACCAGAGGAGA<br>GGCAGATGTCACGGACACGAGGACGGTAGCTTCGAGCAGCCCAAACCCTTGCAAGAGAACA<br>CCCAGAGGGGTATCTTTTCAAGTGCAGGTTGTGCTGAGCTCGGGCTGGGCATAAAAGTCAG<br>GGCAGAGCCATCTATTGCTTACATTTGCTTCTGGCGTGGCCACCATGGCTCCTAAGAAGAAG<br>AGGAAGGTGATGAGCCAGTTCGACATCCTGTGCAAGACCCCCCCAAGGTGCTGGTGCGGC<br>AGTTCGTGGAGAGATTCGAGAGGCCCAGCGGCGAGAAGATCGCCAGCTGTGCCGCCGAGC<br>TGACCTACCTGTGCTGGATGATCACCCACAACGGCACCGCCATCAAGAGGGCCACCTTCATG<br>AGCTACAACACCATCATCAGCAACAGCCTGAGCTTCGACATCGTGAACAAGAGCCTGCAGTT |

| Fig 26 cont'd |
| --- |
| Vector ID (length between ITRs) & Sequence Between ITRs |
| CAAGTACAAGACCCAGAAGGCCACCATCCTGGAGGCCAGCCTGAAGAAGCTGATCCCCGCC TGGGAGTTCACCATCATCCCTTACAACGGCCAGAAGCACCAGAGCGACATCACCGACATCGT GTCCAGCCTGCAGCTGCAGTTCGAGAGCAGCGAGGAGGCCGACAAGGGCAACAGCCACAG CAAGAAGATGCTGAAGGCCCTGCTGTCCGAGGGCGAGAGCATCTGGGAGATCACCGAGAAG ATCCTGAACAGCTTCGAGTACACCAGCAGGTTCACCAAGACCAAGACCCTGTACCAGTTCCT GTTCCTGGCCACATTCATCAACTGCGGCAGGTTCAGCGACATCAAGAACGTGGACCCCAAGA GCTTCAAGCTGGTGCAGAACAAGTACCTGGGCGTGATCATTCAGTGCCTGGTGACCGAGAC CAAGACAAGCGTGTCCAGGCACATCTACTTTTTCAGCGCCAGAGGCAGGATCGACCCCCTG GTGTACCTGGACGAGTTCCTGAGGAACAGCGAGCCCGTGCTGAAGAGAGTGAACAGGACCG GCAACAGCAGCAGCAACAAGCAGGAGTACCAGCTGCTGAAGGACAACCTGGTGCGCAGCTA CAACAAGGCCCTGAAGAAGAACGCCCCCTACCCCATCTTCGCTATCAAGAACGGCCCTAAGA GCCACATCGGCAGGCACCTGATGACCAGCTTTCTGAGCATGAAGGGCCTGACCGAGCTGAC AAACGTGGTGGGCAACTGGAGCGACAAGAGGGCCTCCGCCGTGGCCAGGACCACCTACAC CCACCAGATCACCGCCATCCCCGACCACTACTTCGCCCTGGTGTCCAGGTACTACGCCTACG ACCCCATCAGCAAGGAGATGATCGCCCTGAAGGACGAGACCAACCCCATCGAGGAGTGGCA GCACATCGAGCAGCTGAAGGGCAGCGCCGAGGGCAGCATCAGATACCCCGCCTGGAACGG CATCATCAGCCAGGAGGTGCTGGACTACCTGAGCAGCTACATCAACAGGCGGATCTGAGAAT TCGATATCAAGCTTATCGATAATCAACCTCTGGATTACAAAATTTGTGAAAGATTGACTGGTAT TCTTAACTATGTTGCTCCTTTTACGCTATGTGGATACGCTGCTTTAATGCCTTTGTATCATGCT ATTGCTTCCCGTATGGCTTTCATTTTCTCCTCCTTGTATAAATCCTGGTTGCTGTCTCTTTATG AGGAGTTGTGGCCCGTTGTCAGGCAACGTGGCGTGGTGTGCACTGTGTTTGCTGACGCAAC CCCCACTGGTTGGGGCATTGCCACCACCTGTCAGCTCCTTTCCGGGACTTTCGCTTTCCCCC TCCCTATTGCCACGGCGGAACTCATCGCCGCCTGCCTTGCCCGCTGCTGGACAGGGGCTCG GCTGTTGGGCACTGACAATTCCGTGGTGTTGTCGGGGAAATCATCGTCCTTTCCTTGGCTGC TCGCCTATGTTGCCACCTGGATTCTGCGCGGGACGTCCTTCTGCTACGTCCCTTCGGCCCTC AATCCAGCGGACCTTCCTTCCCGCGGCCTGCTGCCGGCTCTGCGGCCTCTTCCGCGTCTTC GCCTTCGCCCTCAGACGAGTCGGATCTCCCTTTGGGCCGCCTCCCCGCATCGATACCGAGC GCTGCTCGAGAGATCTACGGGTGGCATCCCTGTGACCCCTCCCCAGTGCCTCTCCTGGCCC TGGAAGTTGCCACTCCAGTGCCCACCAGCCTTGTCCTAATAAAATTAAGTTGCATCATTTTGT CTGACTAGGTGTCCTTCTATAATATTATGGGGTGGAGGGGGGTGGTATGGAGCAAGGGGCA AGTTGGGAAGACAACCTGTAGGGCCTGCGGGGTCTATTGGGAACCAAGCTGGAGTGCAGTG GCACAATCTTGGCTCACTGCAATCTCCGCCTCCTGGGTTCAAGCGATTCTCCTGCCTCAGCC TCCCGAGTTGTTGGGATTCCAGGCATGCATGACCAGGCTCAGCTAATTTTTGTTTTTTTGGTA GAGACGGGGTTTCACCATATTGGCCAGGCTGGTCTCCAACTCCTAATCTCAGGTGATCTACC CACCTTGGCCTCCCAAATTGCTGGGATTACAGGCGTGAACCACTGCTCCCTTCCCTGTCCTT CTGATTTTGTAGGTAACCACGTGCGGACCGAGCGGCCGC (SEQ ID NO: 308) |
| 3027 (2868) GCGGCCGCACGCGTAGGGAGACACACACAGACACACACACAGAGAGAGAGAGAGAGAG AGAGAGACAGACAGACAGACAGACAGACTGACTGACTGACTGACTGAGGGAGCAGCTGGAG CTCAAGCCCCAGCTCATGTGGAAGTATCCAAGCTGCTGTTCCTCGTTTGGTTTTGGCATGAA GCACTGTAGTGTAGTAGTGGAAAGAATGGAAGCGATGCACTCTTCTGTTACATCTAACCACTA CATTAAAAATGGATATCCTGATACCTGACCCGAGGCTTGACACAAAACAGACTCACTTTACAA GCACTGCAGGAAATCTCAGAAAAGTGGAGAGAGCTCGGGCTGGGCATAAAAGTCAGGGCAG AGCCATCTATTGCTTACATTTGCTTCTGGCGTGGCCACCATGGCTCCTAAGAAGAAGAGGAA GGTGATGAGCCAGTTCGACATCCTGTGCAAGACCCCCCCCAAGGTGCTGGTGCGGCAGTTC GTGGAGAGATTCGAGAGGCCCAGCGGCGAGAAGATCGCCAGCTGTGCCGCCGAGCTGACC TACCTGTGCTGGATGATCACCCACAACGGCACCGCCATCAAGAGGGCCACCTTCATGAGCTA CAACACCATCATCAGCAACAGCCTGAGCTTCGACATCGTGAACAAGAGCCTGCAGTTCAAGT ACAAGACCCAGAAGGCCACCATCCTGGAGGCCAGCCTGAAGAAGCTGATCCCCGCCTGGGA |

| Fig 26 cont'd |
| Vector ID (length between ITRs) & Sequence Between ITRs |

GTTCACCATCATCCCTTACAACGGCCAGAAGCACCAGAGCGACATCACCGACATCGTGTCCA
GCCTGCAGCTGCAGTTCGAGAGCAGCGAGGAGGCCGACAAGGGCAACAGCCACAGCAAGA
AGATGCTGAAGGCCCTGCTGTCCGAGGGCGAGAGCATCTGGGAGATCACCGAGAAGATCCT
GAACAGCTTCGAGTACACCAGCAGGTTCACCAAGACCAAGACCCTGTACCAGTTCCTGTTCC
TGGCCACATTCATCAACTGCGGCAGGTTCAGCGACATCAAGAACGTGGACCCCAAGAGCTTC
AAGCTGGTGCAGAACAAGTACCTGGGCGTGATCATTCAGTGCCTGGTGACCGAGACCAAGA
CAAGCGTGTCCAGGCACATCTACTTTTTCAGCGCCAGAGGCAGGATCGACCCCCTGGTGTAC
CTGGACGAGTTCCTGAGGAACAGCGAGCCCGTGCTGAAGAGAGTGAACAGGACCGGCAACA
GCAGCAGCAACAAGCAGGAGTACCAGCTGCTGAAGGACAACCTGGTGCGCAGCTACAACAA
GGCCCTGAAGAAGAACGCCCCCTACCCCATCTTCGCTATCAAGAACGGCCCTAAGAGCCAC
ATCGGCAGGCACCTGATGACCAGCTTTCTGAGCATGAAGGGCCTGACCGAGCTGACAAACG
TGGTGGGCAACTGGAGCGACAAGAGGGCCTCCGCCGTGGCCAGGACCACCTACACCCACC
AGATCACCGCCATCCCCGACCACTACTTCGCCCTGGTGTCCAGGTACTACGCCTACGACCCC
ATCAGCAAGGAGATGATCGCCCTGAAGGACGAGACCAACCCCATCGAGGAGTGGCAGCACA
TCGAGCAGCTGAAGGGCAGCGCCGAGGGCAGCATCAGATACCCCGCCTGGAACGGCATCA
TCAGCCAGGAGGTGCTGGACTACCTGAGCAGCTACATCAACAGGCGGATCTGAGAATTCGAT
ATCAAGCTTATCGATAATCAACCTCTGGATTACAAAATTTGTGAAAGATTGACTGGTATTCTTA
ACTATGTTGCTCCTTTTACGCTATGTGGATACGCTGCTTTAATGCCTTTGTATCATGCTATTGC
TTCCCGTATGGCTTTCATTTTCTCCTCCTTGTATAAATCCTGGTTGCTGTCTCTTTATGAGGAG
TTGTGGCCCGTTGTCAGGCAACGTGGCGTGGTGTGCACTGTGTTTGCTGACGCAACCCCCA
CTGGTTGGGGCATTGCCACCACCTGTCAGCTCCTTTCCGGGACTTTCGCTTTCCCCCTCCCT
ATTGCCACGGCGGAACTCATCGCCGCCTGCCTTGCCCGCTGCTGGACAGGGGCTCGGCTGT
TGGGCACTGACAATTCCGTGGTGTTGTCGGGGAAATCATCGTCCTTTCCTTGGCTGCTCGCC
TATGTTGCCACCTGGATTCTGCGCGGGACGTCCTTCTGCTACGTCCCTTCGGCCCTCAATCC
AGCGGACCTTCCTTCCCGCGGCCTGCTGCCGGCTCTGCGGCCTCTTCCGCGTCTTCGCCTT
CGCCCTCAGACGAGTCGGATCTCCCTTTGGGCCGCCTCCCCGCATCGATACCGAGCGCTGC
TCGAGAGATCTACGGGTGGCATCCCTGTGACCCCTCCCCAGTGCCTCTCCTGGCCCTGGAA
GTTGCCACTCCAGTGCCCACCAGCCTTGTCCTAATAAAATTAAGTTGCATCATTTTGTCTGAC
TAGGTGTCCTTCTATAATATTATGGGGTGGAGGGGGGTGGTATGGAGCAAGGGGCAAGTTG
GGAAGACAACCTGTAGGGCCTGCGGGGTCTATTGGGAACCAAGCTGGAGTGCAGTGGCACA
ATCTTGGCTCACTGCAATCTCCGCCTCCTGGGTTCAAGCGATTCTCCTGCCTCAGCCTCCCG
AGTTGTTGGGATTCCAGGCATGCATGACCAGGCTCAGCTAATTTTTGTTTTTTTGGTAGAGAC
GGGGTTTCACCATATTGGCCAGGCTGGTCTCCAACTCCTAATCTCAGGTGATCTACCCACCT
TGGCCTCCCAAATTGCTGGGATTACAGGCGTGAACCACTGCTCCCTTCCCTGTCCTTCTGAT
TTTGTAGGTAACCACGTGCGGACCGAGCGGCCGC (SEQ ID NO: 309)

3028 (2737)
GCGGCCGCACGCGTTCGGTCCGCAGAGGTTCCCTCTGGGGTCAAGCCCTCCAGGCCGATG
TCGCTGTCCTGCGCGTCCTGCATGATGTGTTCGCTCCGGACGCCCTGGGTCCAGCAGAGGG
ACCGGCAGAGGCGGGAGGAAGGTTGAGCCCAGCTGCCTGCACCGCGCTGCTCCGCCCCCG
GCGCTCTAGTCCTGGGGTCCCCCAGTTGAGCTCGGGCTGGGCATAAAAGTCAGGGCAGAGC
CATCTATTGCTTACATTTGCTTCTGGCGTGGCCACCATGGCTCCTAAGAAGAAGAGGAAGGT
GATGAGCCAGTTCGACATCCTGTGCAAGACCCCCCCCAAGGTGCTGGTGCGGCAGTTCGTG
GAGAGATTCGAGAGGCCCAGCGGCGAGAAGATCGCCAGCTGTGCCGCCGAGCTGACCTAC
CTGTGCTGGATGATCACCCACAACGGCACCGCCATCAAGAGGGCCACCTTCATGAGCTACAA
CACCATCATCAGCAACAGCCTGAGCTTCGACATCGTGAACAAGAGCCTGCAGTTCAAGTACA
AGACCCAGAAGGCCACCATCCTGGAGGCCAGCCTGAAGAAGCTGATCCCCGCCTGGGAGTT
CACCATCATCCCTTACAACGGCCAGAAGCACCAGAGCGACATCACCGACATCGTGTCCAGCC
TGCAGCTGCAGTTCGAGAGCAGCGAGGAGGCCGACAAGGGCAACAGCCACAGCAAGAAGA
TGCTGAAGGCCCTGCTGTCCGAGGGCGAGAGCATCTGGGAGATCACCGAGAAGATCCTGAA

| Fig 26 cont'd |
|---|
| Vector ID (length between ITRs) & Sequence Between ITRs |
| CAGCTTCGAGTACACCAGCAGGTTCACCAAGACCAAGACCCTGTACCAGTTCCTGTTCCTGG CCACATTCATCAACTGCGGCAGGTTCAGCGACATCAAGAACGTGGACCCCAAGAGCTTCAAG CTGGTGCAGAACAAGTACCTGGGCGTGATCATTCAGTGCCTGGTGACCGAGACCAAGACAA GCGTGTCCAGGCACATCTACTTTTTCAGCGCCAGAGGCAGGATCGACCCCCTGGTGTACCT GGACGAGTTCCTGAGGAACAGCGAGCCCGTGCTGAAGAGAGTGAACAGGACCGGCAACAG CAGCAGCAACAAGCAGGAGTACCAGCTGCTGAAGGACAACCTGGTGCGCAGCTACAACAAG GCCCTGAAGAAGAACGCCCCCTACCCCATCTTCGCTATCAAGAACGGCCCTAAGAGCCACAT CGGCAGGCACCTGATGACCAGCTTTCTGAGCATGAAGGGCCTGACCGAGCTGACAAACGTG GTGGGCAACTGGAGCGACAAGAGGGCCTCCGCCGTGGCCAGGACCACCTACACCCACCAG ATCACCGCCATCCCCGACCACTACTTCGCCCTGGTGTCCAGGTACTACGCCTACGACCCCAT CAGCAAGGAGATGATCGCCCTGAAGGACGAGACCAACCCCATCGAGGAGTGGCAGCACATC GAGCAGCTGAAGGGCAGCGCCGAGGGCAGCATCAGATACCCCGCCTGGAACGGCATCATC AGCCAGGAGGTGCTGGACTACCTGAGCAGCTACATCAACAGGCGGATCTGAGAATTCGATAT CAAGCTTATCGATAATCAACCTCTGGATTACAAAATTTGTGAAAGATTGACTGGTATTCTTAAC TATGTTGCTCCTTTTACGCTATGTGGATACGCTGCTTTAATGCCTTTGTATCATGCTATTGCTT CCCGTATGGCTTTCATTTTCTCCTCCTTGTATAAATCCTGGTTGCTGTCTCTTTATGAGGAGTT GTGGCCCGTTGTCAGGCAACGTGGCGTGGTGTGCACTGTGTTTGCTGACGCAACCCCCACT GGTTGGGGCATTGCCACCACCTGTCAGCTCCTTTCCGGGACTTTCGCTTTCCCCCTCCCTAT TGCCACGGCGGAACTCATCGCCGCCTGCCTTGCCCGCTGCTGGACAGGGGCTCGGCTGTT GGGCACTGACAATTCCGTGGTGTTGTCGGGGAAATCATCGTCCTTTCCTTGGCTGCTCGCCT ATGTTGCCACCTGGATTCTGCGCGGGACGTCCTTCTGCTACGTCCCTTCGGCCCTCAATCCA GCGGACCTTCCTTCCCGCGGCCTGCTGCCGGCTCTGCGGCCTCTTCCGCGTCTTCGCCTTC GCCCTCAGACGAGTCGGATCTCCCTTTGGGCCGCCTCCCCGCATCGATACCGAGCGCTGCT CGAGAGATCTACGGGTGGCATCCCTGTGACCCCTCCCCAGTGCCTCTCCTGGCCCTGGAAG TTGCCACTCCAGTGCCCACCAGCCTTGTCCTAATAAAATTAAGTTGCATCATTTTGTCTGACTA GGTGTCCTTCTATAATATTATGGGGTGGAGGGGGGTGGTATGGAGCAAGGGGCAAGTTGGG AAGACAACCTGTAGGGCCTGCGGGGTCTATTGGGAACCAAGCTGGAGTGCAGTGGCACAAT CTTGGCTCACTGCAATCTCCGCCTCCTGGGTTCAAGCGATTCTCCTGCCTCAGCCTCCCGAG TTGTTGGGATTCCAGGCATGCATGACCAGGCTCAGCTAATTTTTGTTTTTTTGGTAGAGACGG GGTTTCACCATATTGGCCAGGCTGGTCTCCAACTCCTAATCTCAGGTGATCTACCCACCTTG GCCTCCCAAATTGCTGGGATTACAGGCGTGAACCACTGCTCCCTTCCCTGTCCTTCTGATTTT GTAGGTAACCACGTGCGGACCGAGCGGCCGC (SEQ ID NO: 310) |
| 3029 (3168) GCGGCCGCACGCGTCTGGTACATCTGTGTTACTGCTATGTGAATGAGCCCTGTCTGGCTGTG GCATCTGCAGAGCTCAGCTACTGCCTGTCTGAAAGTTCTTAATCATTTTTATTTTTAGGTTGTG TTGTTTTGTTTTGTTTTGTTTTGTTACACAGTTTTGGGGGAGGTACCATGTGCTAGAACTACT TCTAAGAAAATAATTAAAGACATAGTTTCTCTGGACAGAAATTTGATCCTATTCTTTGTGTTTGA TATGTTTTTATTTAGTTCACGAATAATAATGGATCCTGGAAGCATGTATCTAAGTAGATTGAAA GGTTCGAAAATCAAATTTTGGAAACGATCGTTTACCTCTTCCTTCCACAGAAGAAAGGCTACT GTCTTGAGGACAGCTAAGTGACCACATGGGCTTGATTACTGACCACAGAGCCAACAACTGCT TGTTTTGGCTGCAGCTACTTCTATTTTAGCTTTGACAGTACACCCCAGAGACAAACTTAAAAAA GTTAGTGTGGGAACTGAAAGGCCACAGTTTCTCATTGTTTGCTCTCACCCATTGAGCCCTAAG TCAGGGTGTATGAAATCACTTCACAGTGGTCAGCACAGCAAATGGACAAGGAAAGCTCTGGT GGGGGGGAGCTCGGGCTGGGCATAAAAGTCAGGGCAGAGCCATCTATTGCTTACATTTGCT TCTGGCGTGGCCACCATGGCTCCTAAGAAGAAGAGGAAGGTGATGAGCCAGTTCGACATCC TGTGCAAGACCCCCCCCAAGGTGCTGGTGCGGCAGTTCGTGGAGAGATTCGAGAGGCCCAG CGGCGAGAAGATCGCCAGCTGTGCCGCCGAGCTGACCTACCTGTGCTGGATGATCACCCAC AACGGCACCGCCATCAAGAGGGCCACCTTCATGAGCTACAACACCATCATCAGCAACAGCCT GAGCTTCGACATCGTGAACAAGAGCCTGCAGTTCAAGTACAAGACCCAGAAGGCCACCATCC |

| Fig 26 cont'd |
|---|
| Vector ID (length between ITRs) & Sequence Between ITRs |
| TGGAGGCCAGCCTGAAGAAGCTGATCCCCGCCTGGGAGTTCACCATCATCCCTTACAACGG CCAGAAGCACCAGAGCGACATCACCGACATCGTGTCCAGCCTGCAGCTGCAGTTCGAGAGC AGCGAGGAGGCCGACAAGGGCAACAGCCACAGCAAGAAGATGCTGAAGGCCCTGCTGTCC GAGGGCGAGAGCATCTGGGAGATCACCGAGAAGATCCTGAACAGCTTCGAGTACACCAGCA GGTTCACCAAGACCAAGACCCTGTACCAGTTCCTGTTCCTGGCCACATTCATCAACTGCGGC AGGTTCAGCGACATCAAGAACGTGGACCCCAAGAGCTTCAAGCTGGTGCAGAACAAGTACCT GGGCGTGATCATTCAGTGCCTGGTGACCGAGACCAAGACAAGCGTGTCCAGGCACATCTAC TTTTTCAGCGCCAGAGGCAGGATCGACCCCCTGGTGTACCTGGACGAGTTCCTGAGGAACA GCGAGCCCGTGCTGAAGAGAGTGAACAGGACCGGCAACAGCAGCAGCAACAAGCAGGAGT ACCAGCTGCTGAAGGACAACCTGGTGCGCAGCTACAACAAGGCCCTGAAGAAGAACGCCCC CTACCCCATCTTCGCTATCAAGAACGGCCCTAAGAGCCACATCGGCAGGCACCTGATGACCA GCTTTCTGAGCATGAAGGGCCTGACCGAGCTGACAAACGTGGTGGGCAACTGGAGCGACAA GAGGGCCTCCGCCGTGGCCAGGACCACCTACACCCACCAGATCACCGCCATCCCCGACCAC TACTTCGCCCTGGTGTCCAGGTACTACGCCTACGACCCCATCAGCAAGGAGATGATCGCCCT GAAGGACGAGACCAACCCCATCGAGGAGTGGCAGCACATCGAGCAGCTGAAGGGCAGCGC CGAGGGCAGCATCAGATACCCCGCCTGGAACGGCATCATCAGCCAGGAGGTGCTGGACTAC CTGAGCAGCTACATCAACAGGCGGATCTGAGAATTCGATATCAAGCTTATCGATAATCAACCT CTGGATTACAAAATTTGTGAAAGATTGACTGGTATTCTTAACTATGTTGCTCCTTTTACGCTAT GTGGATACGCTGCTTTAATGCCTTTGTATCATGCTATTGCTTCCCGTATGGCTTTCATTTTCTC CTCCTTGTATAAATCCTGGTTGCTGTCTCTTTATGAGGAGTTGTGGCCCGTTGTCAGGCAACG TGGCGTGGTGTGCACTGTGTTTGCTGACGCAACCCCCACTGGTTGGGGCATTGCCACCACC TGTCAGCTCCTTTCCGGGACTTTCGCTTTCCCCCTCCCTATTGCCACGGCGGAACTCATCGC CGCCTGCCTTGCCCGCTGCTGGACAGGGGCTCGGCTGTTGGGCACTGACAATTCCGTGGTG TTGTCGGGGAAATCATCGTCCTTTCCTTGGCTGCTCGCCTATGTTGCCACCTGGATTCTGCG CGGGACGTCCTTCTGCTACGTCCCTTCGGCCCTCAATCCAGCGGACCTTCCTTCCCGCGGC CTGCTGCCGGCTCTGCGGCCTCTTCCGCGTCTTCGCCTTCGCCCTCAGACGAGTCGGATCT CCCTTTGGGCCGCCTCCCCGCATCGATACCGAGCGCTGCTCGAGAGATCTACGGGTGGCAT CCCTGTGACCCCTCCCCAGTGCCTCTCCTGGCCCTGGAAGTTGCCACTCCAGTGCCCACCA GCCTTGTCCTAATAAAATTAAGTTGCATCATTTTGTCTGACTAGGTGTCCTTCTATAATATTAT GGGGTGGAGGGGGGTGGTATGGAGCAAGGGGCAAGTTGGGAAGACAACCTGTAGGGCCTG CGGGGTCTATTGGGAACCAAGCTGGAGTGCAGTGGCACAATCTTGGCTCACTGCAATCTCC GCCTCCTGGGTTCAAGCGATTCTCCTGCCTCAGCCTCCCGAGTTGTTGGGATTCCAGGCATG CATGACCAGGCTCAGCTAATTTTTGTTTTTTTGGTAGAGACGGGGTTTCACCATATTGGCCAG GCTGGTCTCCAACTCCTAATCTCAGGTGATCTACCCACCTTGGCCTCCCAAATTGCTGGGATT ACAGGCGTGAACCACTGCTCCCTTCCCTGTCCTTCTGATTTTGTAGGTAACCACGTGCGGAC CGAGCGGCCGC (SEQ ID NO: 311) |
| 3030 (3035) GCGGCCGCACGCGTTGAGAGGAGAGGAGAAGGAGGGGTGGGGAGGCACCAGAATTCCTCT CTGCGCTTCTGGAAGCACATTCCTACCGTCGTTATGAGCTGACTGGGGATTTGGGAATTGAC TGCCAGCATCCTTGGATCTCTCTCTTCAGCTTGGCCACTATTCTGACCCTCGTCTCCCCGGT GGATTCTTTCTGGTCCCTGTGAAACAGAAGGGCTGTGGACCTAGCCCCTCCTATAGCAGGCC TCCTGGATTACTTCCTCCATCTGTTCTGCCTCCCACCCTCGGGTCAAGACGTCATCGTCCTCA GATCATCATTTGGTCCAAGGATTTCTCCGTGATGCTCACAATTGTTTACTTTCCTCTGTGCTCC TCTTCTGGCCATTCCCCGGGGTCAGCTTTGGACTCTCTGGGGACAAACCCTTCCCTTGTCAT CCTGTGCTTCCCACACCCACGAGGTCACCGTTTCATGGACTAAATGGATAAGTGACAAGGAC AATGAAGAGGAGCTCGGGCTGGGCATAAAAGTCAGGGCAGAGCCATCTATTGCTTACATTTG CTTCTGGCGTGGCCACCATGGCTCCTAAGAAGAAGAGGAAGGTGATGAGCCAGTTCGACAT CCTGTGCAAGACCCCCCCCAAGGTGCTGGTGCGGCAGTTCGTGGAGAGATTCGAGAGGCCC AGCGGCGAGAAGATCGCCAGCTGTGCCGCCGAGCTGACCTACCTGTGCTGGATGATCACCC |

| Fig 26 cont'd |
| --- |
| Vector ID (length between ITRs) & Sequence Between ITRs |
| ACAACGGCACCGCCATCAAGAGGGCCACCTTCATGAGCTACAACACCATCATCAGCAACAGC<br>CTGAGCTTCGACATCGTGAACAAGAGCCTGCAGTTCAAGTACAAGACCCAGAAGGCCACCAT<br>CCTGGAGGCCAGCCTGAAGAAGCTGATCCCCGCCTGGGAGTTCACCATCATCCCTTACAAC<br>GGCCAGAAGCACCAGAGCGACATCACCGACATCGTGTCCAGCCTGCAGCTGCAGTTCGAGA<br>GCAGCGAGGAGGCCGACAAGGGCAACAGCCACAGCAAGAAGATGCTGAAGGCCCTGCTGT<br>CCGAGGGCGAGAGCATCTGGGAGATCACCGAGAAGATCCTGAACAGCTTCGAGTACACCAG<br>CAGGTTCACCAAGACCAAGACCCTGTACCAGTTCCTGTTCCTGGCCACATTCATCAACTGCG<br>GCAGGTTCAGCGACATCAAGAACGTGGACCCCAAGAGCTTCAAGCTGGTGCAGAACAAGTA<br>CCTGGGCGTGATCATTCAGTGCCTGGTGACCGAGACCAAGACAAGCGTGTCCAGGCACATC<br>TACTTTTTCAGCGCCAGAGGCAGGATCGACCCCCTGGTGTACCTGGACGAGTTCCTGAGGAA<br>CAGCGAGCCCGTGCTGAAGAGAGTGAACAGGACCGGCAACAGCAGCAGCAACAAGCAGGA<br>GTACCAGCTGCTGAAGGACAACCTGGTGCGCAGCTACAACAAGGCCCTGAAGAAGAACGCC<br>CCCTACCCCATCTTCGCTATCAAGAACGGCCCTAAGAGCCACATCGGCAGGCACCTGATGAC<br>CAGCTTTCTGAGCATGAAGGGCCTGACCGAGCTGACAAACGTGGTGGGCAACTGGAGCGAC<br>AAGAGGGCCTCCGCCGTGGCCAGGACCACCTACACCCACCAGATCACCGCCATCCCCGACC<br>ACTACTTCGCCCTGGTGTCCAGGTACTACGCCTACGACCCCATCAGCAAGGAGATGATCGCC<br>CTGAAGGACGAGACCAACCCCATCGAGGAGTGGCAGCACATCGAGCAGCTGAAGGGCAGC<br>GCCGAGGGCAGCATCAGATACCCCGCCTGGAACGGCATCATCAGCCAGGAGGTGCTGGACT<br>ACCTGAGCAGCTACATCAACAGGCGGATCTGAGAATTCGATATCAAGCTTATCGATAATCAAC<br>CTCTGGATTACAAAATTTGTGAAAGATTGACTGGTATTCTTAACTATGTTGCTCCTTTTACGCT<br>ATGTGGATACGCTGCTTTAATGCCTTTGTATCATGCTATTGCTTCCCGTATGGCTTTCATTTTC<br>TCCTCCTTGTATAAATCCTGGTTGCTGTCTCTTTATGAGGAGTTGTGGCCCGTTGTCAGGCAA<br>CGTGGCGTGGTGTGCACTGTGTTTGCTGACGCAACCCCCACTGGTTGGGGCATTGCCACCA<br>CCTGTCAGCTCCTTTCCGGGACTTTCGCTTTCCCCCTCCCTATTGCCACGGCGGAACTCATC<br>GCCGCCTGCCTTGCCCGCTGCTGGACAGGGGCTCGGCTGTTGGGCACTGACAATTCCGTGG<br>TGTTGTCGGGGAAATCATCGTCCTTTCCTTGGCTGCTCGCCTATGTTGCCACCTGGATTCTG<br>CGCGGGACGTCCTTCTGCTACGTCCCTTCGGCCCTCAATCCAGCGGACCTTCCTTCCCGCG<br>GCCTGCTGCCGGCTCTGCGGCCTCTTCCGCGTCTTCGCCTTCGCCCTCAGACGAGTCGGAT<br>CTCCCTTTGGGCCGCCTCCCCGCATCGATACCGAGCGCTGCTCGAGAGATCTACGGGTGGC<br>ATCCCTGTGACCCCTCCCCAGTGCCTCTCCTGGCCCTGGAAGTTGCCACTCCAGTGCCCAC<br>CAGCCTTGTCCTAATAAAATTAAGTTGCATCATTTTGTCTGACTAGGTGTCCTTCTATAATATT<br>ATGGGGTGGAGGGGGGTGGTATGGAGCAAGGGGCAAGTTGGGAAGACAACCTGTAGGGCC<br>TGCGGGGTCTATTGGGAACCAAGCTGGAGTGCAGTGGCACAATCTTGGCTCACTGCAATCTC<br>CGCCTCCTGGGTTCAAGCGATTCTCCTGCCTCAGCCTCCCGAGTTGTTGGGATTCCAGGCAT<br>GCATGACCAGGCTCAGCTAATTTTTGTTTTTTGGTAGAGACGGGGTTTCACCATATTGGCCA<br>GGCTGGTCTCCAACTCCTAATCTCAGGTGATCTACCCACCTTGGCCTCCCAAATTGCTGGGA<br>TTACAGGCGTGAACCACTGCTCCCTTCCCTGTCCTTCTGATTTTGTAGGTAACCACGTGCGG<br>ACCGAGCGGCCGC (SEQ ID NO: 312) |
| 3031 (3168)<br>GCGGCCGCACGCGTGGTGTCCTGTGGGTGCCTTGAGGGTAAGAGGCTCAAGAAATCTTCAA<br>AGTCAGACTCCATTCAAGAGCTGAACTAATGTTGCCTGCCACTAGCGACATTAACCCTCAGG<br>GAGGGTTGGACAGGATCTGGGGAAGCTGCAGGTGCAGAGTGCACTAGAATTTGAACCCCAG<br>GATACAGACAAGAAGCTGCCTAAAGGCAGAGAGCCCTGGGTACCGTGGTCCCAGGAGGCCA<br>AAGCCCCGGAGGTCACAGAGCTGAGCTCATTCTTCCTCTCCAGCTGCAGATGTTGTAAGGGA<br>AAAACAACAAAACAAACAGGAAGTTCTGAGGATGGTTTCCCACGTGTTTCTCTCCATGTTTCT<br>CTCCAGTCACTGCCTCGTCACCCAAACCAGTTTTCTCCTCTCAGCCTCTTGTGCTCCCAGATC<br>AGGCCTCCCTCCCTCAGCCCAGATGTCCCCAACGGGGGTGGGGGGTGGTTTATGCTTCGCT<br>TCTAGGATGCCTGCATCTTAGAAAGGCAAGGTGGCAGGCTGCACAGGCAACTGCATTATCAT<br>TTCTTAATGTCATTTTTTTCTGATCCGTATGATGGGGGAAATGTGCTGGGTGTGGCTCACTCC |

| Fig 26 cont'd |
| --- |
| Vector ID (length between ITRs) & Sequence Between ITRs |
| TGTAATCGTAGCACTCAAGAGAGCTCGGGCTGGGCATAAAAGTCAGGGCAGAGCCATCTATT GCTTACATTTGCTTCTGGCGTGGCCACCATGGCTCCTAAGAAGAAGAGGAAGGTGATGAGCC AGTTCGACATCCTGTGCAAGACCCCCCCCAAGGTGCTGGTGCGGCAGTTCGTGGAGAGATT CGAGAGGCCCAGCGGCGAGAAGATCGCCAGCTGTGCCGCCGAGCTGACCTACCTGTGCTG GATGATCACCCACAACGGCACCGCCATCAAGAGGGCCACCTTCATGAGCTACAACACCATCA TCAGCAACAGCCTGAGCTTCGACATCGTGAACAAGAGCCTGCAGTTCAAGTACAAGACCCAG AAGGCCACCATCCTGGAGGCCAGCCTGAAGAAGCTGATCCCCGCCTGGGAGTTCACCATCA TCCCTTACAACGGCCAGAAGCACCAGAGCGACATCACCGACATCGTGTCCAGCCTGCAGCT GCAGTTCGAGAGCAGCGAGGAGGCCGACAAGGGCAACAGCCACAGCAAGAAGATGCTGAA GGCCCTGCTGTCCGAGGGCGAGAGCATCTGGGAGATCACCGAGAAGATCCTGAACAGCTTC GAGTACACCAGCAGGTTCACCAAGACCAAGACCCTGTACCAGTTCCTGTTCCTGGCCACATT CATCAACTGCGGCAGGTTCAGCGACATCAAGAACGTGGACCCCAAGAGCTTCAAGCTGGTG CAGAACAAGTACCTGGGCGTGATCATTCAGTGCCTGGTGACCGAGACCAAGACAAGCGTGT CCAGGCACATCTACTTTTTCAGCGCCAGAGGCAGGATCGACCCCCTGGTGTACCTGGACGA GTTCCTGAGGAACAGCGAGCCCGTGCTGAAGAGAGTGAACAGGACCGGCAACAGCAGCAG CAACAAGCAGGAGTACCAGCTGCTGAAGGACAACCTGGTGCGCAGCTACAACAAGGCCCTG AAGAAGAACGCCCCCTACCCCATCTTCGCTATCAAGAACGGCCCTAAGAGCCACATCGGCAG GCACCTGATGACCAGCTTTCTGAGCATGAAGGGCCTGACCGAGCTGACAAACGTGGTGGGC AACTGGAGCGACAAGAGGGCCTCCGCCGTGGCCAGGACCACCTACACCCACCAGATCACCG CCATCCCCGACCACTACTTCGCCCTGGTGTCCAGGTACTACGCCTACGACCCCATCAGCAAG GAGATGATCGCCCTGAAGGACGAGACCAACCCCATCGAGGAGTGGCAGCACATCGAGCAGC TGAAGGGCAGCGCCGAGGGCAGCATCAGATACCCCGCCTGGAACGGCATCATCAGCCAGG AGGTGCTGGACTACCTGAGCAGCTACATCAACAGGCGGATCTGAGAATTCGATATCAAGCTT ATCGATAATCAACCTCTGGATTACAAAATTTGTGAAAGATTGACTGGTATTCTTAACTATGTTG CTCCTTTTACGCTATGTGGATACGCTGCTTTAATGCCTTTGTATCATGCTATTGCTTCCCGTAT GGCTTTCATTTTCTCCTCCTTGTATAAATCCTGGTTGCTGTCTCTTTATGAGGAGTTGTGGCC CGTTGTCAGGCAACGTGGCGTGGTGTGCACTGTGTTTGCTGACGCAACCCCCACTGGTTGG GGCATTGCCACCACCTGTCAGCTCCTTTCCGGGACTTTCGCTTTCCCCCTCCCTATTGCCAC GGCGGAACTCATCGCCGCCTGCCTTGCCCGCTGCTGGACAGGGGCTCGGCTGTTGGGCAC TGACAATTCCGTGGTGTTGTCGGGGAAATCATCGTCCTTTCCTTGGCTGCTCGCCTATGTTG CCACCTGGATTCTGCGCGGGACGTCCTTCTGCTACGTCCCTTCGGCCCTCAATCCAGCGGA CCTTCCTTCCCGCGGCCTGCTGCCGGCTCTGCGGCCTCTTCCGCGTCTTCGCCTTCGCCCT CAGACGAGTCGGATCTCCCTTTGGGCCGCCTCCCCGCATCGATACCGAGCGCTGCTCGAGA GATCTACGGGTGGCATCCCTGTGACCCCTCCCCAGTGCCTCTCCTGGCCCTGGAAGTTGCC ACTCCAGTGCCCACCAGCCTTGTCCTAATAAAATTAAGTTGCATCATTTTGTCTGACTAGGTG TCCTTCTATAATATTATGGGGTGGAGGGGGGTGGTATGGAGCAAGGGGCAAGTTGGGAAGA CAACCTGTAGGGCCTGCGGGGTCTATTGGGAACCAAGCTGGAGTGCAGTGGCACAATCTTG GCTCACTGCAATCTCCGCCTCCTGGGTTCAAGCGATTCTCCTGCCTCAGCCTCCCGAGTTGT TGGGATTCCAGGCATGCATGACCAGGCTCAGCTAATTTTTGTTTTTTTGGTAGAGACGGGGTT TCACCATATTGGCCAGGCTGGTCTCCAACTCCTAATCTCAGGTGATCTACCCACCTTGGCCT CCCAAATTGCTGGGATTACAGGCGTGAACCACTGCTCCCTTCCCTGTCCTTCTGATTTTGTAG GTAACCACGTGCGGACCGAGCGGCCGC (SEQ ID NO: 313) |
| 3032 (2966) GCGGCCGCACGCGTCTCTCATGTGGGATTGCTCACAGTTAGCTCAAACCTTACTCTCAGACT TCAGAATCCCTCTTGGACAGAGCAGGAAGGAAGACCATAGTATGTCCAGCTGTACAAATGGA ACACAGACTTCTGATTTCCCATCATACGGCTAACTATAGAAGCAGAGGACACCACACTGCGT GACACTGAAGCTTCTGGCCTTTCTCCCATGACCCCTGCTTCCACATGTCATAACAGTCCCACA GCTGGAAACTAGATGGTCTTCAGATGGCTCTCTCTACCCAGAGAACATCATGCTGCACATTTC CAGGAGAAAAAACCAGAAGTATGACAAAGAAAAACGACAGGAGATTCCTTCAGAGTACAGAC |

| Fig 26 cont'd |
| --- |
| Vector ID (length between ITRs) & Sequence Between ITRs |
| TCCTCTTAGAACAATGAAGATGTTTGACTAAAGCACTCCAAGTTACTTGTGCAATGTGTTGTTG AGCTCGGGCTGGGCATAAAAGTCAGGGCAGAGCCATCTATTGCTTACATTTGCTTCTGGCGT GGCCACCATGGCTCCTAAGAAGAAGAGGAAGGTGATGAGCCAGTTCGACATCCTGTGCAAG ACCCCCCCCAAGGTGCTGGTGCGGCAGTTCGTGGAGAGATTCGAGAGGCCCAGCGGCGAG AAGATCGCCAGCTGTGCCGCCGAGCTGACCTACCTGTGCTGGATGATCACCCACAACGGCA CCGCCATCAAGAGGGCCACCTTCATGAGCTACAACACCATCATCAGCAACAGCCTGAGCTTC GACATCGTGAACAAGAGCCTGCAGTTCAAGTACAAGACCCAGAAGGCCACCATCCTGGAGG CCAGCCTGAAGAAGCTGATCCCCGCCTGGGAGTTCACCATCATCCCTTACAACGGCCAGAA GCACCAGAGCGACATCACCGACATCGTGTCCAGCCTGCAGCTGCAGTTCGAGAGCAGCGAG GAGGCCGACAAGGGCAACAGCCACAGCAAGAAGATGCTGAAGGCCCTGCTGTCCGAGGGC GAGAGCATCTGGGAGATCACCGAGAAGATCCTGAACAGCTTCGAGTACACCAGCAGGTTCA CCAAGACCAAGACCCTGTACCAGTTCCTGTTCCTGGCCACATTCATCAACTGCGGCAGGTTC AGCGACATCAAGAACGTGGACCCCAAGAGCTTCAAGCTGGTGCAGAACAAGTACCTGGGCG TGATCATTCAGTGCCTGGTGACCGAGACCAAGACAAGCGTGTCCAGGCACATCTACTTTTTC AGCGCCAGAGGCAGGATCGACCCCCTGGTGTACCTGGACGAGTTCCTGAGGAACAGCGAG CCCGTGCTGAAGAGAGTGAACAGGACCGGCAACAGCAGCAGCAACAAGCAGGAGTACCAGC TGCTGAAGGACAACCTGGTGCGCAGCTACAACAAGGCCCTGAAGAAGAACGCCCCCTACCC CATCTTCGCTATCAAGAACGGCCCTAAGAGCCACATCGGCAGGCACCTGATGACCAGCTTTC TGAGCATGAAGGGCCTGACCGAGCTGACAAACGTGGTGGGCAACTGGAGCGACAAGAGGG CCTCCGCCGTGGCCAGGACCACCTACACCCACCAGATCACCGCCATCCCCGACCACTACTT CGCCCTGGTGTCCAGGTACTACGCCTACGACCCCATCAGCAAGGAGATGATCGCCCTGAAG GACGAGACCAACCCCATCGAGGAGTGGCAGCACATCGAGCAGCTGAAGGGCAGCGCCGAG GGCAGCATCAGATACCCCGCCTGGAACGGCATCATCAGCCAGGAGGTGCTGGACTACCTGA GCAGCTACATCAACAGGCGGATCTGAGAATTCGATATCAAGCTTATCGATAATCAACCTCTGG ATTACAAAATTTGTGAAAGATTGACTGGTATTCTTAACTATGTTGCTCCTTTTACGCTATGTGG ATACGCTGCTTTAATGCCTTTGTATCATGCTATTGCTTCCCGTATGGCTTTCATTTTCTCCTCC TTGTATAAATCCTGGTTGCTGTCTCTTTATGAGGAGTTGTGGCCCGTTGTCAGGCAACGTGG CGTGGTGTGCACTGTGTTTGCTGACGCAACCCCCACTGGTTGGGGCATTGCCACCACCTGT CAGCTCCTTTCCGGGACTTTCGCTTTCCCCCTCCCTATTGCCACGGCGGAACTCATCGCCGC CTGCCTTGCCCGCTGCTGGACAGGGGCTCGGCTGTTGGGCACTGACAATTCCGTGGTGTTG TCGGGGAAATCATCGTCCTTTCCTTGGCTGCTCGCCTATGTTGCCACCTGGATTCTGCGCGG GACGTCCTTCTGCTACGTCCCTTCGGCCCTCAATCCAGCGGACCTTCCTTCCCGCGGCCTGC TGCCGGCTCTGCGGCCTCTTCCGCGTCTTCGCCTTCGCCCTCAGACGAGTCGGATCTCCCTT TGGGCCGCCTCCCCGCATCGATACCGAGCGCTGCTCGAGAGATCTACGGGTGGCATCCCTG TGACCCCTCCCCAGTGCCTCTCCTGGCCCTGGAAGTTGCCACTCCAGTGCCCACCAGCCTT GTCCTAATAAAATTAAGTTGCATCATTTTGTCTGACTAGGTGTCCTTCTATAATATTATGGGGT GGAGGGGGGTGGTATGGAGCAAGGGGCAAGTTGGGAAGACAACCTGTAGGGCCTGCGGGG TCTATTGGGAACCAAGCTGGAGTGCAGTGGCACAATCTTGGCTCACTGCAATCTCCGCCTCC TGGGTTCAAGCGATTCTCCTGCCTCAGCCTCCCGAGTTGTTGGGATTCCAGGCATGCATGAC CAGGCTCAGCTAATTTTTGTTTTTTTGGTAGAGACGGGGTTTCACCATATTGGCCAGGCTGGT CTCCAACTCCTAATCTCAGGTGATCTACCCACCTTGGCCTCCCAAATTGCTGGGATTACAGG CGTGAACCACTGCTCCCTTCCCTGTCCTTCTGATTTTGTAGGTAACCACGTGCGGACCGAGC GGCCGC (SEQ ID NO: 314) |
| 3033 (2902) GCGGCCGCACGCGTTTAGTTTTCATATAAAGAAACACATTTGCTTTCTGCTCTAATGGTTCTC TTAGGAATCCTGAAGTTCTCAGGAGAATCAAAGCACAGATGTGAGACAGCAAGTTATACTTTC ATTCAGGAGAGAAAAACTTGACAGCCAAGAGAAAAGGAAGCTGCTCTGGATTCCTGTCTCCT GCAGCTGGGAAGTTTTGCAAAGGTCCCCAGGGAGGAACAGGGCCACCAAAGGCTGAGCAAG AGTGACTCGGGAACATTCTGAGTCAAGCAGGGACTGGGGACCAGAATGCAAGATAAGGCAT |

| Fig 26 cont'd |
|---|
| Vector ID (length between ITRs) & Sequence Between ITRs |
| GGAATTAGCGGAGGCCATTTCCCTTGCTTCTCAGGGACCTCCTAAAACACATAGTCCAGGAG<br>GGAGCTCGGGCTGGGCATAAAAGTCAGGGCAGAGCCATCTATTGCTTACATTTGCTTCTGGC<br>GTGGCCACCATGGCTCCTAAGAAGAAGAGGAAGGTGATGAGCCAGTTCGACATCCTGTGCA<br>AGACCCCCCCCAAGGTGCTGGTGCGGCAGTTCGTGGAGAGATTCGAGAGGCCCAGCGGCG<br>AGAAGATCGCCAGCTGTGCCGCCGAGCTGACCTACCTGTGCTGGATGATCACCCACAACGG<br>CACCGCCATCAAGAGGGCCACCTTCATGAGCTACAACACCATCATCAGCAACAGCCTGAGCT<br>TCGACATCGTGAACAAGAGCCTGCAGTTCAAGTACAAGACCCAGAAGGCCACCATCCTGGAG<br>GCCAGCCTGAAGAAGCTGATCCCCGCCTGGGAGTTCACCATCATCCCTTACAACGGCCAGA<br>AGCACCAGAGCGACATCACCGACATCGTGTCCAGCCTGCAGCTGCAGTTCGAGAGCAGCGA<br>GGAGGCCGACAAGGGCAACAGCCACAGCAAGAAGATGCTGAAGGCCCTGCTGTCCGAGGG<br>CGAGAGCATCTGGGAGATCACCGAGAAGATCCTGAACAGCTTCGAGTACACCAGCAGGTTC<br>ACCAAGACCAAGACCCTGTACCAGTTCCTGTTCCTGGCCACATTCATCAACTGCGGCAGGTT<br>CAGCGACATCAAGAACGTGGACCCCAAGAGCTTCAAGCTGGTGCAGAACAAGTACCTGGGC<br>GTGATCATTCAGTGCCTGGTGACCGAGACCAAGACAAGCGTGTCCAGGCACATCTACTTTTT<br>CAGCGCCAGAGGCAGGATCGACCCCCTGGTGTACCTGGACGAGTTCCTGAGGAACAGCGA<br>GCCCGTGCTGAAGAGAGTGAACAGGACCGGCAACAGCAGCAGCAACAAGCAGGAGTACCA<br>GCTGCTGAAGGACAACCTGGTGCGCAGCTACAACAAGGCCCTGAAGAAGAACGCCCCCTAC<br>CCCATCTTCGCTATCAAGAACGGCCCTAAGAGCCACATCGGCAGGCACCTGATGACCAGCTT<br>TCTGAGCATGAAGGGCCTGACCGAGCTGACAAACGTGGTGGGCAACTGGAGCGACAAGAGG<br>GCCTCCGCCGTGGCCAGGACCACCTACACCCACCAGATCACCGCCATCCCCGACCACTACT<br>TCGCCCTGGTGTCCAGGTACTACGCCTACGACCCCATCAGCAAGGAGATGATCGCCCTGAA<br>GGACGAGACCAACCCCATCGAGGAGTGGCAGCACATCGAGCAGCTGAAGGGCAGCGCCGA<br>GGGCAGCATCAGATACCCCGCCTGGAACGGCATCATCAGCCAGGAGGTGCTGGACTACCTG<br>AGCAGCTACATCAACAGGCGGATCTGAGAATTCGATATCAAGCTTATCGATAATCAACCTCTG<br>GATTACAAAATTTGTGAAAGATTGACTGGTATTCTTAACTATGTTGCTCCTTTTACGCTATGTG<br>GATACGCTGCTTTAATGCCTTTGTATCATGCTATTGCTTCCCGTATGGCTTTCATTTTCTCCTC<br>CTTGTATAAATCCTGGTTGCTGTCTCTTTATGAGGAGTTGTGGCCCGTTGTCAGGCAACGTG<br>GCGTGGTGTGCACTGTGTTTGCTGACGCAACCCCCACTGGTTGGGGCATTGCCACCACCTG<br>TCAGCTCCTTTCCGGGACTTTCGCTTTCCCCCTCCCTATTGCCACGGCGGAACTCATCGCCG<br>CCTGCCTTGCCCGCTGCTGGACAGGGGCTCGGCTGTTGGGCACTGACAATTCCGTGGTGTT<br>GTCGGGGAAATCATCGTCCTTTCCTTGGCTGCTCGCCTATGTTGCCACCTGGATTCTGCGCG<br>GGACGTCCTTCTGCTACGTCCCTTCGGCCCTCAATCCAGCGGACCTTCCTTCCCGCGGCCT<br>GCTGCCGGCTCTGCGGCCTCTTCCGCGTCTTCGCCTTCGCCCTCAGACGAGTCGGATCTCC<br>CTTTGGGCCGCCTCCCCGCATCGATACCGAGCGCTGCTCGAGAGATCTACGGGTGGCATCC<br>CTGTGACCCCTCCCCAGTGCCTCTCCTGGCCCTGGAAGTTGCCACTCCAGTGCCCACCAGC<br>CTTGTCCTAATAAAATTAAGTTGCATCATTTTGTCTGACTAGGTGTCCTTCTATAATATTATGG<br>GGTGGAGGGGGGTGGTATGGAGCAAGGGGCAAGTTGGGAAGACAACCTGTAGGGCCTGCG<br>GGGTCTATTGGGAACCAAGCTGGAGTGCAGTGGCACAATCTTGGCTCACTGCAATCTCCGCC<br>TCCTGGGTTCAAGCGATTCTCCTGCCTCAGCCTCCCGAGTTGTTGGGATTCCAGGCATGCAT<br>GACCAGGCTCAGCTAATTTTTGTTTTTTTGGTAGAGACGGGGTTTCACCATATTGGCCAGGCT<br>GGTCTCCAACTCCTAATCTCAGGTGATCTACCCACCTTGGCCTCCCAAATTGCTGGGATTACA<br>GGCGTGAACCACTGCTCCCTTCCCTGTCCTTCTGATTTTGTAGGTAACCACGTGCGGACCGA<br>GCGGCCGC (SEQ ID NO: 315) |
| 3034 (3204)<br>GCGGCCGCACGCGTCAGCTGCTTTTCCTGAAGGCAGCTTCAGCTTTTCCAAAGCCAGGGTG<br>CTGCTGTGGTCAGCTAGTGCTGCACTAAATATCCTCTTCCAAGGGGCTCTGATCCTGGCTCC<br>AGCCCCTCTGGCCTCTGGGACTGGTTTTCTCTATTTCCTTTCCTTCTCCAAGGTTAGCTTTTC<br>AGACTCAACAACATAAATCAAGAGCCTCTAGGGAGGTGAACAGAACTGGCCGGAGAGGAAG<br>CACTGCTTCAGTGGGGGAAGGGGAATGTCCTGGACTAGCAGGCCCCAGTAGGGGTGGAGT |

| Fig 26 cont'd |
| --- |
| Vector ID (length between ITRs) & Sequence Between ITRs |
| GTGGGGGTATGGTGCATACTCAGATGTCTCCTTGGAAGGAGTGGGTGGCAAGGATTCTTCCA TAAACTGATAAGCCGGGACACAGAGTCCCATCCCCCATCCCCACCCTGTTACACTGCTATAA ACAGAGAGGGCTGAAGGCAAAAGGACCCTGCTTGCTGCTGCAGCTGGTCCAGTCTAGGGGG CTCTTCAGTAGAGGACAGCTCTCTTCTTGTCACGTGCTTTCCTCTCTGAACAGAGCTGGTTGT TTTGGGGCACTTGGGCTCCTGTGGACTAATGGGGTCAAGGACCAGGCCAGACACACACTAA GGCCTGGAGTCCCTGGGGACTAGTGGTTCCAGTTCACTAACCTCTGCCCTTCAAATCTGGAG CTCGGGCTGGGCATAAAAGTCAGGGCAGAGCCATCTATTGCTTACATTTGCTTCTGGCGTGG CCACCATGGCTCCTAAGAAGAAGAGGAAGGTGATGAGCCAGTTCGACATCCTGTGCAAGAC CCCCCCCAAGGTGCTGGTGCGGCAGTTCGTGGAGAGATTCGAGAGGCCCAGCGGCGAGAA GATCGCCAGCTGTGCCGCCGAGCTGACCTACCTGTGCTGGATGATCACCCACAACGGCACC GCCATCAAGAGGGCCACCTTCATGAGCTACAACACCATCATCAGCAACAGCCTGAGCTTCGA CATCGTGAACAAGAGCCTGCAGTTCAAGTACAAGACCCAGAAGGCCACCATCCTGGAGGCC AGCCTGAAGAAGCTGATCCCCGCCTGGGAGTTCACCATCATCCCTTACAACGGCCAGAAGCA CCAGAGCGACATCACCGACATCGTGTCCAGCCTGCAGCTGCAGTTCGAGAGCAGCGAGGAG GCCGACAAGGGCAACAGCCACAGCAAGAAGATGCTGAAGGCCCTGCTGTCCGAGGGCGAG AGCATCTGGGAGATCACCGAGAAGATCCTGAACAGCTTCGAGTACACCAGCAGGTTCACCAA GACCAAGACCCTGTACCAGTTCCTGTTCCTGGCCACATTCATCAACTGCGGCAGGTTCAGCG ACATCAAGAACGTGGACCCCAAGAGCTTCAAGCTGGTGCAGAACAAGTACCTGGGCGTGAT CATTCAGTGCCTGGTGACCGAGACCAAGACAAGCGTGTCCAGGCACATCTACTTTTTCAGCG CCAGAGGCAGGATCGACCCCCTGGTGTACCTGGACGAGTTCCTGAGGAACAGCGAGCCCGT GCTGAAGAGAGTGAACAGGACCGGCAACAGCAGCAGCAACAAGCAGGAGTACCAGCTGCTG AAGGACAACCTGGTGCGCAGCTACAACAAGGCCCTGAAGAAGAACGCCCCCTACCCCATCT TCGCTATCAAGAACGGCCCTAAGAGCCACATCGGCAGGCACCTGATGACCAGCTTTCTGAGC ATGAAGGGCCTGACCGAGCTGACAAACGTGGTGGGCAACTGGAGCGACAAGAGGGCCTCC GCCGTGGCCAGGACCACCTACACCCACCAGATCACCGCCATCCCCGACCACTACTTCGCCC TGGTGTCCAGGTACTACGCCTACGACCCCATCAGCAAGGAGATGATCGCCCTGAAGGACGA GACCAACCCCATCGAGGAGTGGCAGCACATCGAGCAGCTGAAGGGCAGCGCCGAGGGCAG CATCAGATACCCCGCCTGGAACGGCATCATCAGCCAGGAGGTGCTGGACTACCTGAGCAGC TACATCAACAGGCGGATCTGAGAATTCGATATCAAGCTTATCGATAATCAACCTCTGGATTAC AAAATTTGTGAAAGATTGACTGGTATTCTTAACTATGTTGCTCCTTTTACGCTATGTGGATACG CTGCTTTAATGCCTTTGTATCATGCTATTGCTTCCCGTATGGCTTTCATTTTCTCCTCCTTGTA TAAATCCTGGTTGCTGTCTCTTTATGAGGAGTTGTGGCCCGTTGTCAGGCAACGTGGCGTGG TGTGCACTGTGTTTGCTGACGCAACCCCCACTGGTTGGGGCATTGCCACCACCTGTCAGCTC CTTTCCGGGACTTTCGCTTTCCCCCTCCCTATTGCCACGGCGGAACTCATCGCCGCCTGCCT TGCCCGCTGCTGGACAGGGGCTCGGCTGTTGGGCACTGACAATTCCGTGGTGTTGTCGGGG AAATCATCGTCCTTTCCTTGGCTGCTCGCCTATGTTGCCACCTGGATTCTGCGCGGGACGTC CTTCTGCTACGTCCCTTCGGCCCTCAATCCAGCGGACCTTCCTTCCCGCGGCCTGCTGCCG GCTCTGCGGCCTCTTCCGCGTCTTCGCCTTCGCCCTCAGACGAGTCGGATCTCCCTTTGGG CCGCCTCCCCGCATCGATACCGAGCGCTGCTCGAGAGATCTACGGGTGGCATCCCTGTGAC CCCTCCCCAGTGCCTCTCCTGGCCCTGGAAGTTGCCACTCCAGTGCCCACCAGCCTTGTCCT AATAAAATTAAGTTGCATCATTTTGTCTGACTAGGTGTCCTTCTATAATATTATGGGGTGGAGG GGGGTGGTATGGAGCAAGGGGCAAGTTGGGAAGACAACCTGTAGGGCCTGCGGGGTCTATT GGGAACCAAGCTGGAGTGCAGTGGCACAATCTTGGCTCACTGCAATCTCCGCCTCCTGGGT TCAAGCGATTCTCCTGCCTCAGCCTCCCGAGTTGTTGGGATTCCAGGCATGCATGACCAGGC TCAGCTAATTTTTGTTTTTTTGGTAGAGACGGGGTTTCACCATATTGGCCAGGCTGGTCTCCA ACTCCTAATCTCAGGTGATCTACCCACCTTGGCCTCCCAAATTGCTGGGATTACAGGCGTGA ACCACTGCTCCCTTCCCTGTCCTTCTGATTTTGTAGGTAACCACGTGCGGACCGAGCGGCCG C (SEQ ID NO: 316) |

| Fig 26 cont'd |
| Vector ID (length between ITRs) & Sequence Between ITRs |

3035 (3020)
GCGGCCGCACGCGTCGAGACCTAAACAGCCGCCGTGGAGGTCATAGTCCTAGTCAGGTTCC
TGCGCAGAGGCCCTAAGCTGCCGAGTGACAAGCAGAAGGGTGAGTGGAGGCAATGACAGTC
ATCTGGCAGGGAGGAGGAACGCCAGACTCCTTGGAATGCTGTGGTGGTTTTCTTTAAAGTTG
TTCCCCATGGGAATCAAGGCAGTCATCCCAGGGGGTGGGGGGAAAGGGTTTAAGACTTCCT
TCCTCAGAAAAGGACACTGCTACTGTACTGCAGCTGCAAGGGAATGCCTGCTATGTTGTGGT
TGATGCTGACCCAGGATGGAATGCAGATGAAGGATGCTTTTAGGAAACAAGTCTGCTTGGAA
TGCTGGGTGGCAATCCTTAGCTTTTGGTCGAGTGGAAGCCTGGCCTCACTTGTCAACAATGA
AAACTAGGTTGGTTAGAACCTAATAGACTCCCTGGCTCCTGCCCCCCATGCTCACTGTTAGA
GCTCGGGCTGGGCATAAAAGTCAGGGCAGAGCCATCTATTGCTTACATTTGCTTCTGGCGTG
GCCACCATGGCTCCTAAGAAGAAGAGGAAGGTGATGAGCCAGTTCGACATCCTGTGCAAGA
CCCCCCCCAAGGTGCTGGTGCGGCAGTTCGTGGAGAGATTCGAGAGGCCCAGCGGCGAGA
AGATCGCCAGCTGTGCCGCCGAGCTGACCTACCTGTGCTGGATGATCACCCACAACGGCAC
CGCCATCAAGAGGGCCACCTTCATGAGCTACAACACCATCATCAGCAACAGCCTGAGCTTCG
ACATCGTGAACAAGAGCCTGCAGTTCAAGTACAAGACCCAGAAGGCCACCATCCTGGAGGC
CAGCCTGAAGAAGCTGATCCCCGCCTGGGAGTTCACCATCATCCCTTACAACGGCCAGAAG
CACCAGAGCGACATCACCGACATCGTGTCCAGCCTGCAGCTGCAGTTCGAGAGCAGCGAGG
AGGCCGACAAGGGCAACAGCCACAGCAAGAAGATGCTGAAGGCCCTGCTGTCCGAGGGCG
AGAGCATCTGGGAGATCACCGAGAAGATCCTGAACAGCTTCGAGTACACCAGCAGGTTCACC
AAGACCAAGACCCTGTACCAGTTCCTGTTCCTGGCCACATTCATCAACTGCGGCAGGTTCAG
CGACATCAAGAACGTGGACCCCAAGAGCTTCAAGCTGGTGCAGAACAAGTACCTGGGCGTG
ATCATTCAGTGCCTGGTGACCGAGACCAAGACAAGCGTGTCCAGGCACATCTACTTTTTCAG
CGCCAGAGGCAGGATCGACCCCCTGGTGTACCTGGACGAGTTCCTGAGGAACAGCGAGCC
CGTGCTGAAGAGAGTGAACAGGACCGGCAACAGCAGCAGCAACAAGCAGGAGTACCAGCTG
CTGAAGGACAACCTGGTGCGCAGCTACAACAAGGCCCTGAAGAAGAACGCCCCCTACCCCA
TCTTCGCTATCAAGAACGGCCCTAAGAGCCACATCGGCAGGCACCTGATGACCAGCTTTCTG
AGCATGAAGGGCCTGACCGAGCTGACAAACGTGGTGGGCAACTGGAGCGACAAGAGGGCC
TCCGCCGTGGCCAGGACCACCTACACCCACCAGATCACCGCCATCCCCGACCACTACTTCG
CCCTGGTGTCCAGGTACTACGCCTACGACCCCATCAGCAAGGAGATGATCGCCCTGAAGGA
CGAGACCAACCCCATCGAGGAGTGGCAGCACATCGAGCAGCTGAAGGGCAGCGCCGAGGG
CAGCATCAGATACCCCGCCTGGAACGGCATCATCAGCCAGGAGGTGCTGGACTACCTGAGC
AGCTACATCAACAGGCGGATCTGAGAATTCGATATCAAGCTTATCGATAATCAACCTCTGGAT
TACAAAATTTGTGAAAGATTGACTGGTATTCTTAACTATGTTGCTCCTTTTACGCTATGTGGAT
ACGCTGCTTTAATGCCTTTGTATCATGCTATTGCTTCCCGTATGGCTTTCATTTTCTCCTCCTT
GTATAAATCCTGGTTGCTGTCTCTTTATGAGGAGTTGTGGCCCGTTGTCAGGCAACGTGGCG
TGGTGTGCACTGTGTTTGCTGACGCAACCCCCACTGGTTGGGGCATTGCCACCACCTGTCAG
CTCCTTTCCGGGACTTTCGCTTTCCCCCTCCCTATTGCCACGGCGGAACTCATCGCCGCCTG
CCTTGCCCGCTGCTGGACAGGGGCTCGGCTGTTGGGCACTGACAATTCCGTGGTGTTGTCG
GGGAAATCATCGTCCTTTCCTTGGCTGCTCGCCTATGTTGCCACCTGGATTCTGCGCGGGAC
GTCCTTCTGCTACGTCCCTTCGGCCCTCAATCCAGCGGACCTTCCTTCCCGCGGCCTGCTGC
CGGCTCTGCGGCCTCTTCCGCGTCTTCGCCTTCGCCCTCAGACGAGTCGGATCTCCCTTTG
GGCCGCCTCCCCGCATCGATACCGAGCGCTGCTCGAGAGATCTACGGGTGGCATCCCTGTG
ACCCCTCCCCAGTGCCTCTCCTGGCCCTGGAAGTTGCCACTCCAGTGCCCACCAGCCTTGT
CCTAATAAAATTAAGTTGCATCATTTTGTCTGACTAGGTGTCCTTCTATAATATTATGGGGTGG
AGGGGGGTGGTATGGAGCAAGGGGCAAGTTGGGAAGACAACCTGTAGGGCCTGCGGGGTC
TATTGGGAACCAAGCTGGAGTGCAGTGGCACAATCTTGGCTCACTGCAATCTCCGCCTCCTG
GGTTCAAGCGATTCTCCTGCCTCAGCCTCCCGAGTTGTTGGGATTCCAGGCATGCATGACCA
GGCTCAGCTAATTTTTGTTTTTTTGGTAGAGACGGGGTTTCACCATATTGGCCAGGCTGGTCT
CCAACTCCTAATCTCAGGTGATCTACCCACCTTGGCCTCCCAAATTGCTGGGATTACAGGCG

| Fig 26 cont'd |
| --- |
| Vector ID (length between ITRs) & Sequence Between ITRs |
| TGAACCACTGCTCCCTTCCCTGTCCTTCTGATTTTGTAGGTAACCACGTGCGGACCGAGCGG CCGC (SEQ ID NO: 317) |
| 3036 (3210)<br>GCGGCCGCACGCGTGGGTCTCCCTAGCCCAACCCAAAAGAGAAAGGATGCAGGAAGGATGT GGAGAGGGAGGCAGGAATCGGGCCAGAAGCACCCTCAAGTCCTCTCCTCCCCCCTCCTCCC TCACTTCCACTTGAGGAGTCCTCTCTTTTCTCTCTCCCTCTCCCCTCCTCCTTCCTTCCCAGT CCTCTCTCCCCTCCCCCTTCCCTTTTGTCCTCCCCCCTTCAGCACCCCCTCCAATTTTCTCTC CTACTTCTCTCTCCCCTTCCCCTCCCCCCTCCCCCCTCCTCCCTGTTCTTTCTCCCTGCCCAG GCCCACTGCCTCCCCTAGCCCCTGCTCCCAGAAAGCCCTGGAAAGGCAGCTTTCTTTGAGAC AGGAAGGTGTCCTCAAGTCTCAGGAAGGAAAAACAGTCGAGCTGAACCCAAGACCGTCTCCA AGGGGCTGGGGCTGGCTCCGGGCCAGGGCTGACATCACCTGGGAACCACTGCCTCTGCAG CTGCAGCCCGCCTCCTGGGGGGATGCTTCTGCTATTTAAAAAATAATAATAATACTAAAAAAA CTTTTCCAGTCTGGTGTTTTTAAATGTGCTTTATATAGTGGGCCCTGGGGTGTGGGAGATTCA ATCCCCTCCCGTTTGTCCTCACAGCCCGGGTTTCTCACACCGCACTGGGCAGCCTTCCGAGA GCTCGGGCTGGGCATAAAAGTCAGGGCAGAGCCATCTATTGCTTACATTTGCTTCTGGCGTG GCCACCATGGCTCCTAAGAAGAAGAGGAAGGTGATGAGCCAGTTCGACATCCTGTGCAAGA CCCCCCCCAAGGTGCTGGTGCGGCAGTTCGTGGAGAGATTCGAGAGGCCCAGCGGCGAGA AGATCGCCAGCTGTGCCGCCGAGCTGACCTACCTGTGCTGGATGATCACCCACAACGGCAC CGCCATCAAGAGGGCCACCTTCATGAGCTACAACACCATCATCAGCAACAGCCTGAGCTTCG ACATCGTGAACAAGAGCCTGCAGTTCAAGTACAAGACCCAGAAGGCCACCATCCTGGAGGC CAGCCTGAAGAAGCTGATCCCCGCCTGGGAGTTCACCATCATCCCTTACAACGGCCAGAAG CACCAGAGCGACATCACCGACATCGTGTCCAGCCTGCAGCTGCAGTTCGAGAGCAGCGAGG AGGCCGACAAGGGCAACAGCCACAGCAAGAAGATGCTGAAGGCCCTGCTGTCCGAGGGCG AGAGCATCTGGGAGATCACCGAGAAGATCCTGAACAGCTTCGAGTACACCAGCAGGTTCACC AAGACCAAGACCCTGTACCAGTTCCTGTTCCTGGCCACATTCATCAACTGCGGCAGGTTCAG CGACATCAAGAACGTGGACCCCAAGAGCTTCAAGCTGGTGCAGAACAAGTACCTGGGCGTG ATCATTCAGTGCCTGGTGACCGAGACCAAGACAAGCGTGTCCAGGCACATCTACTTTTTCAG CGCCAGAGGCAGGATCGACCCCCTGGTGTACCTGGACGAGTTCCTGAGGAACAGCGAGCC CGTGCTGAAGAGAGTGAACAGGACCGGCAACAGCAGCAGCAACAAGCAGGAGTACCAGCTG CTGAAGGACAACCTGGTGCGCAGCTACAACAAGGCCCTGAAGAAGAACGCCCCCTACCCCA TCTTCGCTATCAAGAACGGCCCTAAGAGCCACATCGGCAGGCACCTGATGACCAGCTTTCTG AGCATGAAGGGCCTGACCGAGCTGACAAACGTGGTGGGCAACTGGAGCGACAAGAGGGCC TCCGCCGTGGCCAGGACCACCTACACCCACCAGATCACCGCCATCCCCGACCACTACTTCG CCCTGGTGTCCAGGTACTACGCCTACGACCCCATCAGCAAGGAGATGATCGCCCTGAAGGA CGAGACCAACCCCATCGAGGAGTGGCAGCACATCGAGCAGCTGAAGGGCAGCGCCGAGGG CAGCATCAGATACCCCGCCTGGAACGGCATCATCAGCCAGGAGGTGCTGGACTACCTGAGC AGCTACATCAACAGGCGGATCTGAGAATTCGATATCAAGCTTATCGATAATCAACCTCTGGAT TACAAAATTTGTGAAAGATTGACTGGTATTCTTAACTATGTTGCTCCTTTTACGCTATGTGGAT ACGCTGCTTTAATGCCTTTGTATCATGCTATTGCTTCCCGTATGGCTTTCATTTTCTCCTCCTT GTATAAATCCTGGTTGCTGTCTCTTTATGAGGAGTTGTGGCCCGTTGTCAGGCAACGTGGCG TGGTGTGCACTGTGTTTGCTGACGCAACCCCCACTGGTTGGGGCATTGCCACCACCTGTCAG CTCCTTTCCGGGACTTTCGCTTTCCCCCTCCCTATTGCCACGGCGGAACTCATCGCCGCCTG CCTTGCCCGCTGCTGGACAGGGGCTCGGCTGTTGGGCACTGACAATTCCGTGGTGTTGTCG GGGAAATCATCGTCCTTTCCTTGGCTGCTCGCCTATGTTGCCACCTGGATTCTGCGCGGGAC GTCCTTCTGCTACGTCCCTTCGGCCCTCAATCCAGCGGACCTTCCTTCCCGCGGCCTGCTGC CGGCTCTGCGGCCTCTTCCGCGTCTTCGCCTTCGCCCTCAGACGAGTCGGATCTCCCTTTG GGCCGCCTCCCCGCATCGATACCGAGCGCTGCTCGAGAGATCTACGGGTGGCATCCCTGTG ACCCCTCCCCAGTGCCTCTCCTGGCCCTGGAAGTTGCCACTCCAGTGCCCACCAGCCTTGT CCTAATAAAATTAAGTTGCATCATTTTGTCTGACTAGGTGTCCTTCTATAATATTATGGGGTGG |

| Fig 26 cont'd |
|---|
| Vector ID (length between ITRs) & Sequence Between ITRs |
| AGGGGGGTGGTATGGAGCAAGGGGCAAGTTGGGAAGACAACCTGTAGGGCCTGCGGGGTC TATTGGGAACCAAGCTGGAGTGCAGTGGCACAATCTTGGCTCACTGCAATCTCCGCCTCCTG GGTTCAAGCGATTCTCCTGCCTCAGCCTCCCGAGTTGTTGGGATTCCAGGCATGCATGACCA GGCTCAGCTAATTTTTGTTTTTTTGGTAGAGACGGGGGTTTCACCATATTGGCCAGGCTGGTCT CCAACTCCTAATCTCAGGTGATCTACCCACCTTGGCCTCCCAAATTGCTGGGATTACAGGCG TGAACCACTGCTCCCTTCCCTGTCCTTCTGATTTTGTAGGTAACCACGTGCGGACCGAGCGG CCGC (SEQ ID NO: 318) |
| 3037 (3185) GCGGCCGCACGCGTAGTAACTTCATTTCCCTCTCTAAATTTGGGTTCCTTCTATATCTGGCCA ATGGTCATTTTCAGAAAAGAAGGGCAGTCCTAGCTGCAGGAGCACTTTAAGGAGTTGTTTATT ATGAGTAACAGATGTAGTAGGAGAGGTGAGACTGAGTACAGACCTTTCTAGACATTTTCTACA AGAAATCCTGGCAGCTGTAATTCCCTTAGGTGGCTGGTCATCATCAGAAGGCCTCTGAGAGA TGATCAAGAGGTCAATTTTGACAGAAAATGGTAAAAATTTGTGGATTGTCCGTATTACTTCCCA TTCCTGACAACTGTTCCTTCTTAAAGGCCAGTTCTGAAAGGTCAGAGTGTGGAAATACATGCG CCAGAAAAAGGCTTGCAGCAGGGCTTTTTACCATAAATGCTGCAAATTAGTGCTTCAAGGTCC CAGTGAGAAAGACCTTTTAACTTTCTCTGCTGTTGACATCAGGATAATAACTGTGGGAAGAG TGGAAGGGCAGATCCTGTTTAAAAAAGAAAATTGGACCTTCAGGGAGAAAAGGAAGGATCTT CGTATCCTTTCCCACAAATGCAAGACAATTGTCCTAGGAAAACACAGCCTATGATCACAGCAC AGCAAGGCAAGTTCCCAGAACATCTGAGAGCTCGGGCTGGGCATAAAAGTCAGGGCAGAGC CATCTATTGCTTACATTTGCTTCTGGCGTGGCCACCATGGCTCCTAAGAAGAAGAGGAAGGT GATGAGCCAGTTCGACATCCTGTGCAAGACCCCCCCCAAGGTGCTGGTGCGGCAGTTCGTG GAGAGATTCGAGAGGCCCAGCGGCGAGAAGATCGCCAGCTGTGCCGCCGAGCTGACCTAC CTGTGCTGGATGATCACCCACAACGGCACCGCCATCAAGAGGGCCACCTTCATGAGCTACAA CACCATCATCAGCAACAGCCTGAGCTTCGACATCGTGAACAAGAGCCTGCAGTTCAAGTACA AGACCCAGAAGGCCACCATCCTGGAGGCCAGCCTGAAGAAGCTGATCCCCGCCTGGGAGTT CACCATCATCCCTTACAACGGCCAGAAGCACCAGAGCGACATCACCGACATCGTGTCCAGCC TGCAGCTGCAGTTCGAGAGCAGCGAGGAGGCCGACAAGGGCAACAGCCACAGCAAGAAGA TGCTGAAGGCCCTGCTGTCCGAGGGCGAGAGCATCTGGGAGATCACCGAGAAGATCCTGAA CAGCTTCGAGTACACCAGCAGGTTCACCAAGACCAAGACCCTGTACCAGTTCCTGTTCCTGG CCACATTCATCAACTGCGGCAGGTTCAGCGACATCAAGAACGTGGACCCCAAGAGCTTCAAG CTGGTGCAGAACAAGTACCTGGGCGTGATCATTCAGTGCCTGGTGACCGAGACCAAGACAA GCGTGTCCAGGCACATCTACTTTTTCAGCGCCAGAGGCAGGATCGACCCCCTGGTGTACCT GGACGAGTTCCTGAGGAACAGCGAGCCCGTGCTGAAGAGAGTGAACAGGACCGGCAACAG CAGCAGCAACAAGCAGGAGTACCAGCTGCTGAAGGACAACCTGGTGCGCAGCTACAACAAG GCCCTGAAGAAGAACGCCCCCTACCCCATCTTCGCTATCAAGAACGGCCCTAAGAGCCACAT CGGCAGGCACCTGATGACCAGCTTTCTGAGCATGAAGGGCCTGACCGAGCTGACAAACGTG GTGGGCAACTGGAGCGACAAGAGGGCCTCCGCCGTGGCCAGGACCACCTACACCCACCAG ATCACCGCCATCCCCGACCACTACTTCGCCCTGGTGTCCAGGTACTACGCCTACGACCCCAT CAGCAAGGAGATGATCGCCCTGAAGGACGAGACCAACCCCATCGAGGAGTGGCAGCACATC GAGCAGCTGAAGGGCAGCGCCGAGGGCAGCATCAGATACCCCGCCTGGAACGGCATCATC AGCCAGGAGGTGCTGGACTACCTGAGCAGCTACATCAACAGGCGGATCTGAGAATTCGATAT CAAGCTTATCGATAATCAACCTCTGGATTACAAAATTTGTGAAAGATTGACTGGTATTCTTAAC TATGTTGCTCCTTTTACGCTATGTGGATACGCTGCTTTAATGCCTTTGTATCATGCTATTGCTT CCCGTATGGCTTTCATTTTCTCCTCCTTGTATAAATCCTGGTTGCTGTCTCTTTATGAGGAGTT GTGGCCCGTTGTCAGGCAACGTGGCGTGGTGTGCACTGTGTTTGCTGACGCAACCCCCACT GGTTGGGGCATTGCCACCACCTGTCAGCTCCTTTCCGGGACTTTCGCTTTCCCCCTCCCTAT TGCCACGGCGGAACTCATCGCCGCCTGCCTTGCCCGCTGCTGGACAGGGGCTCGGCTGTT GGGCACTGACAATTCCGTGGTGTTGTCGGGGAAATCATCGTCCTTTCCTTGGCTGCTCGCCT ATGTTGCCACCTGGATTCTGCGCGGGACGTCCTTCTGCTACGTCCCTTCGGCCCTCAATCCA |

| Fig 26 cont'd |
| :--- |
| Vector ID (length between ITRs) & Sequence Between ITRs |
| GCGGACCTTCCTTCCCGCGGCCTGCTGCCGGCTCTGCGGCCTCTTCCGCGTCTTCGCCTTC GCCCTCAGACGAGTCGGATCTCCCTTTGGGCCGCCTCCCCGCATCGATACCGAGCGCTGCT CGAGAGATCTACGGGTGGCATCCCTGTGACCCCTCCCCAGTGCCTCTCCTGGCCCTGGAAG TTGCCACTCCAGTGCCCACCAGCCTTGTCCTAATAAAATTAAGTTGCATCATTTTGTCTGACTA GGTGTCCTTCTATAATATTATGGGGTGGAGGGGGGTGGTATGGAGCAAGGGGCAAGTTGGG AAGACAACCTGTAGGGCCTGCGGGGTCTATTGGGAACCAAGCTGGAGTGCAGTGGCACAAT CTTGGCTCACTGCAATCTCCGCCTCCTGGGTTCAAGCGATTCTCCTGCCTCAGCCTCCCGAG TTGTTGGGATTCCAGGCATGCATGACCAGGCTCAGCTAATTTTTGTTTTTTTGGTAGAGACGG GGTTTCACCATATTGGCCAGGCTGGTCTCCAACTCCTAATCTCAGGTGATCTACCCACCTTG GCCTCCCAAATTGCTGGGATTACAGGCGTGAACCACTGCTCCCTTCCCTGTCCTTCTGATTTT GTAGGTAACCACGTGCGGACCGAGCGGCCGC (SEQ ID NO: 319) |
| 3038 (3091) GCGGCCGCACGCGTGCCGTATCTCATTTTTAGACATTTAAGTTACTTCCAACTTTTCCTGCTT ATCAGTTACGTCAGCATGGCTATTTTTATACCTAGATGGCCTGTGTTCCTGACTGCTTGGAAG TAGACTTACTGGGTCAAAGGGGATGCCAGTGTGATTTTCAGAAACGATGCCCGTTTCTGTTC ACAGCTGGTTTCTATAAAGCATGGGAACGGCGCAGGCACTATTTATGTGCCCTGCTGAATTC TCAGCTCCCTGCTTCATCTGACCTTCCGCCACTACTCAGAATCGGCTCTGTTCTTCTCCTGGG CTCCCGATGGGAGCCAAGCTGGACTTGTGTCAGTGTATTAAGAAGTGCTCGTTATAGCTCAT TGCCCATGGGATGTCGACTGCTGCTGATTTCTCAGGGCTGGAGATGACACATTTTCTCACATT CTTCAAAAGTCTTAAGGTTCAGCAGGAGAGAAGGAAGGTCCGAGCCAAGGAGAGCTGCGGC CATACCGACAGGGAGGGCACTCTCTCTTTCTCTAGCTCTCCCCCCCCCCCCTTGAAAAGGGG GAGCTCGGGCTGGGCATAAAAGTCAGGGCAGAGCCATCTATTGCTTACATTTGCTTCTGGCG TGGCCACCATGGCTCCTAAGAAGAAGAGGAAGGTGATGAGCCAGTTCGACATCCTGTGCAA GACCCCCCCCAAGGTGCTGGTGCGGCAGTTCGTGGAGAGATTCGAGAGGCCCAGCGGCGA GAAGATCGCCAGCTGTGCCGCCGAGCTGACCTACCTGTGCTGGATGATCACCCACAACGGC ACCGCCATCAAGAGGGCCACCTTCATGAGCTACAACACCATCATCAGCAACAGCCTGAGCTT CGACATCGTGAACAAGAGCCTGCAGTTCAAGTACAAGACCCAGAAGGCCACCATCCTGGAG GCCAGCCTGAAGAAGCTGATCCCCGCCTGGGAGTTCACCATCATCCCTTACAACGGCCAGA AGCACCAGAGCGACATCACCGACATCGTGTCCAGCCTGCAGCTGCAGTTCGAGAGCAGCGA GGAGGCCGACAAGGGCAACAGCCACAGCAAGAAGATGCTGAAGGCCCTGCTGTCCGAGGG CGAGAGCATCTGGGAGATCACCGAGAAGATCCTGAACAGCTTCGAGTACACCAGCAGGTTC ACCAAGACCAAGACCCTGTACCAGTTCCTGTTCCTGGCCACATTCATCAACTGCGGCAGGTT CAGCGACATCAAGAACGTGGACCCCAAGAGCTTCAAGCTGGTGCAGAACAAGTACCTGGGC GTGATCATTCAGTGCCTGGTGACCGAGACCAAGACAAGCGTGTCCAGGCACATCTACTTTTT CAGCGCCAGAGGCAGGATCGACCCCCTGGTGTACCTGGACGAGTTCCTGAGGAACAGCGA GCCCGTGCTGAAGAGAGTGAACAGGACCGGCAACAGCAGCAGCAACAAGCAGGAGTACCA GCTGCTGAAGGACAACCTGGTGCGCAGCTACAACAAGGCCCTGAAGAAGAACGCCCCCTAC CCCATCTTCGCTATCAAGAACGGCCCTAAGAGCCACATCGGCAGGCACCTGATGACCAGCTT TCTGAGCATGAAGGGCCTGACCGAGCTGACAAACGTGGTGGGCAACTGGAGCGACAAGAGG GCCTCCGCCGTGGCCAGGACCACCTACACCCACCAGATCACCGCCATCCCCGACCACTACT TCGCCCTGGTGTCCAGGTACTACGCCTACGACCCCATCAGCAAGGAGATGATCGCCCTGAA GGACGAGACCAACCCCATCGAGGAGTGGCAGCACATCGAGCAGCTGAAGGGCAGCGCCGA GGGCAGCATCAGATACCCCGCCTGGAACGGCATCATCAGCCAGGAGGTGCTGGACTACCTG AGCAGCTACATCAACAGGCGGATCTGAGAATTCGATATCAAGCTTATCGATAATCAACCTCTG GATTACAAAATTTGTGAAAGATTGACTGGTATTCTTAACTATGTTGCTCCTTTTACGCTATGTG GATACGCTGCTTTAATGCCTTTGTATCATGCTATTGCTTCCCGTATGGCTTTCATTTTCTCCTC CTTGTATAAATCCTGGTTGCTGTCTCTTTATGAGGAGTTGTGGCCCGTTGTCAGGCAACGTG GCGTGGTGTGCACTGTGTTTGCTGACGCAACCCCCACTGGTTGGGGCATTGCCACCACCTG TCAGCTCCTTTCCGGGACTTTCGCTTTCCCCCTCCCTATTGCCACGGCGGAACTCATCGCCG |

| Fig 26 cont'd |
| --- |
| Vector ID (length between ITRs) & Sequence Between ITRs |
| CCTGCCTTGCCCGCTGCTGGACAGGGGCTCGGCTGTTGGGCACTGACAATTCCGTGGTGTT<br>GTCGGGGAAATCATCGTCCTTTCCTTGGCTGCTCGCCTATGTTGCCACCTGGATTCTGCGCG<br>GGACGTCCTTCTGCTACGTCCCTTCGGCCCTCAATCCAGCGGACCTTCCTTCCCGCGGCCT<br>GCTGCCGGCTCTGCGGCCTCTTCCGCGTCTTCGCCTTCGCCCTCAGACGAGTCGGATCTCC<br>CTTTGGGCCGCCTCCCCGCATCGATACCGAGCGCTGCTCGAGAGATCTACGGGTGGCATCC<br>CTGTGACCCCTCCCCAGTGCCTCTCCTGGCCCTGGAAGTTGCCACTCCAGTGCCCACCAGC<br>CTTGTCCTAATAAAATTAAGTTGCATCATTTTGTCTGACTAGGTGTCCTTCTATAATATTATGG<br>GGTGGAGGGGGGTGGTATGGAGCAAGGGGCAAGTTGGGAAGACAACCTGTAGGGCCTGCG<br>GGGTCTATTGGGAACCAAGCTGGAGTGCAGTGGCACAATCTTGGCTCACTGCAATCTCCGCC<br>TCCTGGGTTCAAGCGATTCTCCTGCCTCAGCCTCCCGAGTTGTTGGGATTCCAGGCATGCAT<br>GACCAGGCTCAGCTAATTTTTGTTTTTTTGGTAGAGACGGGGTTTCACCATATTGGCCAGGCT<br>GGTCTCCAACTCCTAATCTCAGGTGATCTACCCACCTTGGCCTCCCAAATTGCTGGGATTACA<br>GGCGTGAACCACTGCTCCCTTCCCTGTCCTTCTGATTTTGTAGGTAACCACGTGCGGACCGA<br>GCGGCCGC (SEQ ID NO: 320) |
| 3039 (3250)<br>GCGGCCGCACGCGTGCAGGGCATGGTGGAGCATGCTTGCAATCTTCCAACTTAGGAGGCAA<br>AAGCAAGAGGGTCATCAGAAGTTCAAGTCCATTCTCACCTACGTAACAAACTTTATGCCTAGG<br>CTGGGTTATGTGAGACCTTATCTCAAAATAGCCACTCATGTAAACAACAAAGAAAAACCCCAA<br>CTGTTTAGGGAACTCTCACGCTTCAGGAGCCATACCGAAATAGGAAGAAAATCCTTGTGGCA<br>CAGTGTTTCTGGACAGATGTGAGAGGAATCAGTTGAGACTAAGCTGACCTTTAGTTTAGTTGC<br>AGCTGGAGCTCAGATTCATCGCCTGAATATTATTTAACTAGTTTCCTGGCGAAGAGCTTCCAT<br>CCAAGAACTAAACATGTTCTGCGCTGAGCATGAAAGACCCAACCTTTGATTAATCTTTCCTGT<br>TCAAACTTTTCACCACTGCGGAGCACTTCCCAAACACAAGGGTTCTTGGAAAAGAGACTGCA<br>CACTTGGTTAAGGAGCCAGAGAGGAGCAAACTGCAAATGCTTGAAACAGCACCACCCAAGTC<br>CCAGCTCCCTCTCAGACTCCAGGATTTGGAATGCTAATCTGAGGACCTCCTTCCACCATGGA<br>TGACAGGCAGAAACAGAAACCTAATACAGTCACTCACTGAGGTAGTAGGACACAGCATGGTT<br>TTTTTTTTTTTTCCCAGCACTTTCCTTAACTCTTTGAGCTCGGGCTGGGCATAAAAGTCAGGG<br>CAGAGCCATCTATTGCTTACATTTGCTTCTGGCGTGGCCACCATGGCTCCTAAGAAGAAGAG<br>GAAGGTGATGAGCCAGTTCGACATCCTGTGCAAGACCCCCCCCAAGGTGCTGGTGCGGCAG<br>TTCGTGGAGAGATTCGAGAGGCCCAGCGGCGAGAAGATCGCCAGCTGTGCCGCCGAGCTG<br>ACCTACCTGTGCTGGATGATCACCCACAACGGCACCGCCATCAAGAGGGCCACCTTCATGA<br>GCTACAACACCATCATCAGCAACAGCCTGAGCTTCGACATCGTGAACAAGAGCCTGCAGTTC<br>AAGTACAAGACCCAGAAGGCCACCATCCTGGAGGCCAGCCTGAAGAAGCTGATCCCCGCCT<br>GGGAGTTCACCATCATCCCTTACAACGGCCAGAAGCACCAGAGCGACATCACCGACATCGT<br>GTCCAGCCTGCAGCTGCAGTTCGAGAGCAGCGAGGAGGCCGACAAGGGCAACAGCCACAG<br>CAAGAAGATGCTGAAGGCCCTGCTGTCCGAGGGCGAGAGCATCTGGGAGATCACCGAGAAG<br>ATCCTGAACAGCTTCGAGTACACCAGCAGGTTCACCAAGACCAAGACCCTGTACCAGTTCCT<br>GTTCCTGGCCACATTCATCAACTGCGGCAGGTTCAGCGACATCAAGAACGTGGACCCCAAGA<br>GCTTCAAGCTGGTGCAGAACAAGTACCTGGGCGTGATCATTCAGTGCCTGGTGACCGAGAC<br>CAAGACAAGCGTGTCCAGGCACATCTACTTTTTCAGCGCCAGAGGCAGGATCGACCCCCTG<br>GTGTACCTGGACGAGTTCCTGAGGAACAGCGAGCCCGTGCTGAAGAGAGTGAACAGGACCG<br>GCAACAGCAGCAGCAACAAGCAGGAGTACCAGCTGCTGAAGGACAACCTGGTGCGCAGCTA<br>CAACAAGGCCCTGAAGAAGAACGCCCCCTACCCCATCTTCGCTATCAAGAACGGCCCTAAGA<br>GCCACATCGGCAGGCACCTGATGACCAGCTTTCTGAGCATGAAGGGCCTGACCGAGCTGAC<br>AAACGTGGTGGGCAACTGGAGCGACAAGAGGGCCTCCGCCGTGGCCAGGACCACCTACAC<br>CCACCAGATCACCGCCATCCCCGACCACTACTTCGCCCTGGTGTCCAGGTACTACGCCTACG<br>ACCCCATCAGCAAGGAGATGATCGCCCTGAAGGACGAGACCAACCCCATCGAGGAGTGGCA<br>GCACATCGAGCAGCTGAAGGGCAGCGCCGAGGGCAGCATCAGATACCCCGCCTGGAACGG<br>CATCATCAGCCAGGAGGTGCTGGACTACCTGAGCAGCTACATCAACAGGCGGATCTGAGAAT |

| Fig 26 cont'd |
|---|
| Vector ID (length between ITRs) & Sequence Between ITRs |
| TCGATATCAAGCTTATCGATAATCAACCTCTGGATTACAAAATTTGTGAAAGATTGACTGGTAT<br>TCTTAACTATGTTGCTCCTTTTACGCTATGTGGATACGCTGCTTTAATGCCTTTGTATCATGCT<br>ATTGCTTCCCGTATGGCTTTCATTTTCTCCTCCTTGTATAAATCCTGGTTGCTGTCTCTTTATG<br>AGGAGTTGTGGCCCGTTGTCAGGCAACGTGGCGTGGTGTGCACTGTGTTTGCTGACGCAAC<br>CCCCACTGGTTGGGGCATTGCCACCACCTGTCAGCTCCTTTCCGGGACTTTCGCTTTCCCCC<br>TCCCTATTGCCACGGCGGAACTCATCGCCGCCTGCCTTGCCCGCTGCTGGACAGGGGCTCG<br>GCTGTTGGGCACTGACAATTCCGTGGTGTTGTCGGGGAAATCATCGTCCTTTCCTTGGCTGC<br>TCGCCTATGTTGCCACCTGGATTCTGCGCGGGACGTCCTTCTGCTACGTCCCTTCGGCCCTC<br>AATCCAGCGGACCTTCCTTCCCGCGGCCTGCTGCCGGCTCTGCGGCCTCTTCCGCGTCTTC<br>GCCTTCGCCCTCAGACGAGTCGGATCTCCCTTTGGGCCGCCTCCCCGCATCGATACCGAGC<br>GCTGCTCGAGAGATCTACGGGTGGCATCCCTGTGACCCCTCCCCAGTGCCTCTCCTGGCCC<br>TGGAAGTTGCCACTCCAGTGCCCACCAGCCTTGTCCTAATAAAATTAAGTTGCATCATTTTGT<br>CTGACTAGGTGTCCTTCTATAATATTATGGGGTGGAGGGGGGTGGTATGGAGCAAGGGGCA<br>AGTTGGGAAGACAACCTGTAGGGCCTGCGGGGTCTATTGGGAACCAAGCTGGAGTGCAGTG<br>GCACAATCTTGGCTCACTGCAATCTCCGCCTCCTGGGTTCAAGCGATTCTCCTGCCTCAGCC<br>TCCCGAGTTGTTGGGATTCCAGGCATGCATGACCAGGCTCAGCTAATTTTTGTTTTTTTGGTA<br>GAGACGGGGTTTCACCATATTGGCCAGGCTGGTCTCCAACTCCTAATCTCAGGTGATCTACC<br>CACCTTGGCCTCCCAAATTGCTGGGATTACAGGCGTGAACCACTGCTCCCTTCCCTGTCCTT<br>CTGATTTTGTAGGTAACCACGTGCGGACCGAGCGGCCGC (SEQ ID NO: 321) |
| 3040 (3028)<br>GCGGCCGCACGCGTTCATGAGGAACAACTGAAAACTGTTTGTTTCCCTGAATCCATGACAAC<br>AGGAACTTAGTCCAAAACTCAGCCATGAATGTTGGTAACGTGGGCACTGCAGCGACCTGAAA<br>GAATTCGGGCCCGGCTTGCATGTTGAACACAGAGTTGCCAGTGGCATACTTTTTTGGTAGAG<br>AGGAATAGAAAACCCTGGCTTCCTCTGAGAATTGAATGCCTCCTCCCAATGCAGTCCAAATTC<br>CACTGAGAACCTTAACCTTATAAGGGAAGGCAGCTTTTGAGTCACAGGCCTTTGCTGTTTCTT<br>TCTCACTGGCTGGCCTGGAATGAGCCTCTGCTAAAAATGTTCCAAGCAGCTATTGACCTAGA<br>CATTTCTCTCTTCTTTTCTAGCAACTTATATGTGTGTGCTGAAAGAATGCTGCACGTTCCTGTG<br>ACCTCACTCACCCCTCTGAGTGCCTTCTTGGAAAGGAGATGTAGGTGGAGGGTTTCCCAGAG<br>AGCTCGGGCTGGGCATAAAAGTCAGGGCAGAGCCATCTATTGCTTACATTTGCTTCTGGCGT<br>GGCCACCATGGCTCCTAAGAAGAAGAGGAAGGTGATGAGCCAGTTCGACATCCTGTGCAAG<br>ACCCCCCCCAAGGTGCTGGTGCGGCAGTTCGTGGAGAGATTCGAGAGGCCCAGCGGCGAG<br>AAGATCGCCAGCTGTGCCGCCGAGCTGACCTACCTGTGCTGGATGATCACCCACAACGGCA<br>CCGCCATCAAGAGGGCCACCTTCATGAGCTACAACACCATCATCAGCAACAGCCTGAGCTTC<br>GACATCGTGAACAAGAGCCTGCAGTTCAAGTACAAGACCCAGAAGGCCACCATCCTGGAGG<br>CCAGCCTGAAGAAGCTGATCCCCGCCTGGGAGTTCACCATCATCCCTTACAACGGCCAGAA<br>GCACCAGAGCGACATCACCGACATCGTGTCCAGCCTGCAGCTGCAGTTCGAGAGCAGCGAG<br>GAGGCCGACAAGGGCAACAGCCACAGCAAGAAGATGCTGAAGGCCCTGCTGTCCGAGGGC<br>GAGAGCATCTGGGAGATCACCGAGAAGATCCTGAACAGCTTCGAGTACACCAGCAGGTTCA<br>CCAAGACCAAGACCCTGTACCAGTTCCTGTTCCTGGCCACATTCATCAACTGCGGCAGGTTC<br>AGCGACATCAAGAACGTGGACCCCAAGAGCTTCAAGCTGGTGCAGAACAAGTACCTGGGCG<br>TGATCATTCAGTGCCTGGTGACCGAGACCAAGACAAGCGTGTCCAGGCACATCTACTTTTTC<br>AGCGCCAGAGGCAGGATCGACCCCCTGGTGTACCTGGACGAGTTCCTGAGGAACAGCGAG<br>CCCGTGCTGAAGAGAGTGAACAGGACCGGCAACAGCAGCAGCAACAAGCAGGAGTACCAGC<br>TGCTGAAGGACAACCTGGTGCGCAGCTACAACAAGGCCCTGAAGAAGAACGCCCCCTACCC<br>CATCTTCGCTATCAAGAACGGCCCTAAGAGCCACATCGGCAGGCACCTGATGACCAGCTTTC<br>TGAGCATGAAGGGCCTGACCGAGCTGACAAACGTGGTGGGCAACTGGAGCGACAAGAGGG<br>CCTCCGCCGTGGCCAGGACCACCTACACCCACCAGATCACCGCCATCCCCGACCACTACTT<br>CGCCCTGGTGTCCAGGTACTACGCCTACGACCCCATCAGCAAGGAGATGATCGCCCTGAAG<br>GACGAGACCAACCCCATCGAGGAGTGGCAGCACATCGAGCAGCTGAAGGGCAGCGCCGAG |

| Fig 26 cont'd |
|---|
| Vector ID (length between ITRs) & Sequence Between ITRs |
| GGCAGCATCAGATACCCCGCCTGGAACGGCATCATCAGCCAGGAGGTGCTGGACTACCTGA GCAGCTACATCAACAGGCGGATCTGAGAATTCGATATCAAGCTTATCGATAATCAACCTCTGG ATTACAAAATTTGTGAAAGATTGACTGGTATTCTTAACTATGTTGCTCCTTTTACGCTATGTGG ATACGCTGCTTTAATGCCTTTGTATCATGCTATTGCTTCCCGTATGGCTTTCATTTTCTCCTCC TTGTATAAATCCTGGTTGCTGTCTCTTTATGAGGAGTTGTGGCCCGTTGTCAGGCAACGTGG CGTGGTGTGCACTGTGTTTGCTGACGCAACCCCCACTGGTTGGGGCATTGCCACCACCTGT CAGCTCCTTTCCGGGACTTTCGCTTTCCCCCTCCCTATTGCCACGGCGGAACTCATCGCCGC CTGCCTTGCCCGCTGCTGGACAGGGGCTCGGCTGTTGGGCACTGACAATTCCGTGGTGTTG TCGGGGAAATCATCGTCCTTTCCTTGGCTGCTCGCCTATGTTGCCACCTGGATTCTGCGCGG GACGTCCTTCTGCTACGTCCCTTCGGCCCTCAATCCAGCGGACCTTCCTTCCCGCGGCCTGC TGCCGGCTCTGCGGCCTCTTCCGCGTCTTCGCCTTCGCCCTCAGACGAGTCGGATCTCCCTT TGGGCCGCCTCCCCGCATCGATACCGAGCGCTGCTCGAGAGATCTACGGGTGGCATCCCTG TGACCCCTCCCCAGTGCCTCTCCTGGCCCTGGAAGTTGCCACTCCAGTGCCCACCAGCCTT GTCCTAATAAAATTAAGTTGCATCATTTTGTCTGACTAGGTGTCCTTCTATAATATTATGGGGT GGAGGGGGGTGGTATGGAGCAAGGGGCAAGTTGGGAAGACAACCTGTAGGGCCTGCGGGG TCTATTGGGAACCAAGCTGGAGTGCAGTGGCACAATCTTGGCTCACTGCAATCTCCGCCTCC TGGGTTCAAGCGATTCTCCTGCCTCAGCCTCCCGAGTTGTTGGGATTCCAGGCATGCATGAC CAGGCTCAGCTAATTTTTGTTTTTTTGGTAGAGACGGGGTTTCACCATATTGGCCAGGCTGGT CTCCAACTCCTAATCTCAGGTGATCTACCCACCTTGGCCTCCCAAATTGCTGGGATTACAGG CGTGAACCACTGCTCCCTTCCCTGTCCTTCTGATTTTGTAGGTAACCACGTGCGGACCGAGC GGCCGC (SEQ ID NO: 322) |
| 3041 (3066) GCGGCCGCACGCGTTCCTATGAGAACCACAGTGTCATCCCATCTAATGACTGACAGCATCCA TCCATGATTCCTGGAGAATGGGCCTCTGGGTGGGACTGAGGCAGCATCTCTTTCATGTGTGA GAATGGACTCAATGACCTGCCAAGGTCTTTTTCTGGTCCATGGCTCTGGGTACAGCTGCAAA AATAAACTTATGGTTACAGCAATGGAAACAGGCCTGTAAATACAGGTCGCCAGGACGCAACT CTGTGACACAGGCAATGACAAATTCCCAGTGTGCATTTGCGTGACTTGCACATTCTCTCTGG GAAAGCCTGCCCTGGGATCCTACAAACAGAAATGTGGGAATACTTTTGTCCAGTGAGTATAAT GCCACAGGCCAGACTTGATCTTCCCTCCATGTTCCCTCGACATTTTGGCCAGAGACCAATATA TCTTTAGTAATTCCTCAAGACCCATGGGAACTGAATCAAGGGAGGCTCTCCACATCACACACA CACACACTCACACACACACACACACACACACACAGAGCTCGGGCTGGGCATAAAAGTC AGGGCAGAGCCATCTATTGCTTACATTTGCTTCTGGCGTGGCCACCATGGCTCCTAAGAAGA AGAGGAAGGTGATGAGCCAGTTCGACATCCTGTGCAAGACCCCCCCCAAGGTGCTGGTGCG GCAGTTCGTGGAGAGATTCGAGAGGCCCAGCGGCGAGAAGATCGCCAGCTGTGCCGCCGA GCTGACCTACCTGTGCTGGATGATCACCCACAACGGCACCGCCATCAAGAGGGCCACCTTC ATGAGCTACAACACCATCATCAGCAACAGCCTGAGCTTCGACATCGTGAACAAGAGCCTGCA GTTCAAGTACAAGACCCAGAAGGCCACCATCCTGGAGGCCAGCCTGAAGAAGCTGATCCCC GCCTGGGAGTTCACCATCATCCCTTACAACGGCCAGAAGCACCAGAGCGACATCACCGACAT CGTGTCCAGCCTGCAGCTGCAGTTCGAGAGCAGCGAGGAGGCCGACAAGGGCAACAGCCA CAGCAAGAAGATGCTGAAGGCCCTGCTGTCCGAGGGCGAGAGCATCTGGGAGATCACCGAG AAGATCCTGAACAGCTTCGAGTACACCAGCAGGTTCACCAAGACCAAGACCCTGTACCAGTT CCTGTTCCTGGCCACATTCATCAACTGCGGCAGGTTCAGCGACATCAAGAACGTGGACCCCA AGAGCTTCAAGCTGGTGCAGAACAAGTACCTGGGCGTGATCATTCAGTGCCTGGTGACCGA GACCAAGACAAGCGTGTCCAGGCACATCTACTTTTTCAGCGCCAGAGGCAGGATCGACCCC CTGGTGTACCTGGACGAGTTCCTGAGGAACAGCGAGCCCGTGCTGAAGAGAGTGAACAGGA CCGGCAACAGCAGCAGCAACAAGCAGGAGTACCAGCTGCTGAAGGACAACCTGGTGCGCAG CTACAACAAGGCCCTGAAGAAGAACGCCCCCTACCCCATCTTCGCTATCAAGAACGGCCCTA AGAGCCACATCGGCAGGCACCTGATGACCAGCTTTCTGAGCATGAAGGGCCTGACCGAGCT GACAAACGTGGTGGGCAACTGGAGCGACAAGAGGGCCTCCGCCGTGGCCAGGACCACCTA |

| Fig 26 cont'd |
|---|
| Vector ID (length between ITRs) & Sequence Between ITRs |
| CACCCACCAGATCACCGCCATCCCCGACCACTACTTCGCCCTGGTGTCCAGGTACTACGCCT ACGACCCCATCAGCAAGGAGATGATCGCCCTGAAGGACGAGACCAACCCCATCGAGGAGTG GCAGCACATCGAGCAGCTGAAGGGCAGCGCCGAGGGCAGCATCAGATACCCCGCCTGGAA CGGCATCATCAGCCAGGAGGTGCTGGACTACCTGAGCAGCTACATCAACAGGCGGATCTGA GAATTCGATATCAAGCTTATCGATAATCAACCTCTGGATTACAAAATTTGTGAAAGATTGACTG GTATTCTTAACTATGTTGCTCCTTTTACGCTATGTGGATACGCTGCTTTAATGCCTTTGTATCA TGCTATTGCTTCCCGTATGGCTTTCATTTTCTCCTCCTTGTATAAATCCTGGTTGCTGTCTCTT TATGAGGAGTTGTGGCCCGTTGTCAGGCAACGTGGCGTGGTGTGCACTGTGTTTGCTGACG CAACCCCCACTGGTTGGGGCATTGCCACCACCTGTCAGCTCCTTTCCGGGACTTTCGCTTTC CCCCTCCCTATTGCCACGGCGGAACTCATCGCCGCCTGCCTTGCCCGCTGCTGGACAGGGG CTCGGCTGTTGGGCACTGACAATTCCGTGGTGTTGTCGGGGAAATCATCGTCCTTTCCTTGG CTGCTCGCCTATGTTGCCACCTGGATTCTGCGCGGGACGTCCTTCTGCTACGTCCCTTCGGC CCTCAATCCAGCGGACCTTCCTTCCCGCGGCCTGCTGCCGGCTCTGCGGCCTCTTCCGCGT CTTCGCCTTCGCCCTCAGACGAGTCGGATCTCCCTTTGGGCCGCCTCCCCGCATCGATACC GAGCGCTGCTCGAGAGATCTACGGGTGGCATCCCTGTGACCCCTCCCCAGTGCCTCTCCTG GCCCTGGAAGTTGCCACTCCAGTGCCCACCAGCCTTGTCCTAATAAAATTAAGTTGCATCATT TTGTCTGACTAGGTGTCCTTCTATAATATTATGGGGTGGAGGGGGGTGGTATGGAGCAAGGG GCAAGTTGGGAAGACAACCTGTAGGGCCTGCGGGGTCTATTGGGAACCAAGCTGGAGTGCA GTGGCACAATCTTGGCTCACTGCAATCTCCGCCTCCTGGGTTCAAGCGATTCTCCTGCCTCA GCCTCCCGAGTTGTTGGGATTCCAGGCATGCATGACCAGGCTCAGCTAATTTTTGTTTTTTTG GTAGAGACGGGGTTTCACCATATTGGCCAGGCTGGTCTCCAACTCCTAATCTCAGGTGATCT ACCCACCTTGGCCTCCCAAATTGCTGGGATTACAGGCGTGAACCACTGCTCCCTTCCCTGTC CTTCTGATTTTGTAGGTAACCACGTGCGGACCGAGCGGCCGC (SEQ ID NO: 323) |
| 3042 (3017) GCGGCCGCACGCGTCCAGGGCGGTCCCAGGCCTCAGAGCTCCAAGGGACGGGAAGTACCC AGTGAAGCAAGGGACAGCCCTGGTGGAATAACTCCTTCACAGCTCCATCCCAGAAGTCAGC GGCCACCCAGGGCAGCTGGTACACCACAGTGACGAACCTGATTGCCAGTCAGCCTGGCAGC CACAAGAATGGGGTAATTCTACAAGGACCAGGGCCAGAGCTGTCTGTAAGGGGTTAAAAAAA AAAAAAAAAAAAAAGGACACTCCTCGGTCCCCAGGAGTTAAAGGGAATCCTGGCAAGCCACCC AGGAGAACTCTCTGGAGGCATGTTTGACTTTTAAATTCCAAACTCTAGCTGCCCCAGTGCTTC AGAGAGATGTTGCCAAACGAGTTCAAAGAGACATGCATGGGTCAAACAGTAACCACTCTACA AGAGAAGCTGCTTTGTGTGTTCTGAGGTAGCTGATAACATGGACACAGGAATACTCTGAGCT CGGGCTGGGCATAAAAGTCAGGGCAGAGCCATCTATTGCTTACATTTGCTTCTGGCGTGGCC ACCATGGCTCCTAAGAAGAAGAGGAAGGTGATGAGCCAGTTCGACATCCTGTGCAAGACCC CCCCCAAGGTGCTGGTGCGGCAGTTCGTGGAGAGATTCGAGAGGCCCAGCGGCGAGAAGA TCGCCAGCTGTGCCGCCGAGCTGACCTACCTGTGCTGGATGATCACCCACAACGGCACCGC CATCAAGAGGGCCACCTTCATGAGCTACAACACCATCATCAGCAACAGCCTGAGCTTCGACA TCGTGAACAAGAGCCTGCAGTTCAAGTACAAGACCCAGAAGGCCACCATCCTGGAGGCCAG CCTGAAGAAGCTGATCCCCGCCTGGGAGTTCACCATCATCCCTTACAACGGCCAGAAGCACC AGAGCGACATCACCGACATCGTGTCCAGCCTGCAGCTGCAGTTCGAGAGCAGCGAGGAGGC CGACAAGGGCAACAGCCACAGCAAGAAGATGCTGAAGGCCCTGCTGTCCGAGGGCGAGAG CATCTGGGAGATCACCGAGAAGATCCTGAACAGCTTCGAGTACACCAGCAGGTTCACCAAGA CCAAGACCCTGTACCAGTTCCTGTTCCTGGCCACATTCATCAACTGCGGCAGGTTCAGCGAC ATCAAGAACGTGGACCCCAAGAGCTTCAAGCTGGTGCAGAACAAGTACCTGGGCGTGATCAT TCAGTGCCTGGTGACCGAGACCAAGACAAGCGTGTCCAGGCACATCTACTTTTTCAGCGCCA GAGGCAGGATCGACCCCCTGGTGTACCTGGACGAGTTCCTGAGGAACAGCGAGCCCGTGCT GAAGAGAGTGAACAGGACCGGCAACAGCAGCAGCAACAAGCAGGAGTACCAGCTGCTGAAG GACAACCTGGTGCGCAGCTACAACAAGGCCCTGAAGAAGAACGCCCCCTACCCCATCTTCG CTATCAAGAACGGCCCTAAGAGCCACATCGGCAGGCACCTGATGACCAGCTTTCTGAGCATG |

| Fig 26 cont'd |
|---|
| Vector ID (length between ITRs) & Sequence Between ITRs |

AAGGGCCTGACCGAGCTGACAAACGTGGTGGGCAACTGGAGCGACAAGAGGGCCTCCGCC
GTGGCCAGGACCACCTACACCCACCAGATCACCGCCATCCCCGACCACTACTTCGCCCTGG
TGTCCAGGTACTACGCCTACGACCCCATCAGCAAGGAGATGATCGCCCTGAAGGACGAGAC
CAACCCCATCGAGGAGTGGCAGCACATCGAGCAGCTGAAGGGCAGCGCCGAGGGCAGCAT
CAGATACCCCGCCTGGAACGGCATCATCAGCCAGGAGGTGCTGGACTACCTGAGCAGCTAC
ATCAACAGGCGGATCTGAGAATTCGATATCAAGCTTATCGATAATCAACCTCTGGATTACAAA
ATTTGTGAAAGATTGACTGGTATTCTTAACTATGTTGCTCCTTTTACGCTATGTGGATACGCTG
CTTTAATGCCTTTGTATCATGCTATTGCTTCCCGTATGGCTTTCATTTTCTCCTCCTTGTATAAA
TCCTGGTTGCTGTCTCTTTATGAGGAGTTGTGGCCCGTTGTCAGGCAACGTGGCGTGGTGTG
CACTGTGTTTGCTGACGCAACCCCCACTGGTTGGGGCATTGCCACCACCTGTCAGCTCCTTT
CCGGGACTTTCGCTTTCCCCCTCCCTATTGCCACGGCGGAACTCATCGCCGCCTGCCTTGCC
CGCTGCTGGACAGGGGCTCGGCTGTTGGGCACTGACAATTCCGTGGTGTTGTCGGGGAAAT
CATCGTCCTTTCCTTGGCTGCTCGCCTATGTTGCCACCTGGATTCTGCGCGGGACGTCCTTC
TGCTACGTCCCTTCGGCCCTCAATCCAGCGGACCTTCCTTCCCGCGGCCTGCTGCCGGCTC
TGCGGCCTCTTCCGCGTCTTCGCCTTCGCCCTCAGACGAGTCGGATCTCCCTTTGGGCCGC
CTCCCCGCATCGATACCGAGCGCTGCTCGAGAGATCTACGGGTGGCATCCCTGTGACCCCT
CCCCAGTGCCTCTCCTGGCCCTGGAAGTTGCCACTCCAGTGCCCACCAGCCTTGTCCTAATA
AAATTAAGTTGCATCATTTTGTCTGACTAGGTGTCCTTCTATAATATTATGGGGTGGAGGGGG
GTGGTATGGAGCAAGGGGCAAGTTGGGAAGACAACCTGTAGGGCCTGCGGGGTCTATTGGG
AACCAAGCTGGAGTGCAGTGGCACAATCTTGGCTCACTGCAATCTCCGCCTCCTGGGTTCAA
GCGATTCTCCTGCCTCAGCCTCCCGAGTTGTTGGGATTCCAGGCATGCATGACCAGGCTCAG
CTAATTTTTGTTTTTTTGGTAGAGACGGGGTTTCACCATATTGGCCAGGCTGGTCTCCAACTC
CTAATCTCAGGTGATCTACCCACCTTGGCCTCCCAAATTGCTGGGATTACAGGCGTGAACCA
CTGCTCCCTTCCCTGTCCTTCTGATTTTGTAGGTAACCACGTGCGGACCGAGCGGCCGC
(SEQ ID NO: 324)

| 3043 (2998) |
|---|

GCGGCCGCACGCGTCATCGCACAGCTTAGCCTGTGGCCCCCGGAGTTTGGACAGTGTCCCT
GAGAGAGAAGTTGAGGTGCTGGTACCCCGTCCAGCCTGCCTGTCCGGCTGTCCTGCTCCTG
CCAACCCAGGCCTACTCCCAACCCCCCACCACCACAGGCAGGCAACTTGGCCCTGGGATCG
GTACAGTCCAGTACACATGTCTTGTCAATCACAACTTGCTCAAAATAGTTGCTGGCTGCATTT
TCCCTCCCCCAACTGTGTTACTCCTAGAACTAATTATAGTACAAATTTCTGCCTTCCATGTCCC
TTTTACTGCATGGACCTTTTAGTCAGGACTCAGTATCAGATCTCTGGGTTTTTTAACTAAGTGA
TCTATCAGGCACCATGCCTTCCTCCAAGGATCATGAACCTAACTGCTTTTGGCCAAAGTCCAT
CGGAAAGTGACATCAACAGAGACTTCAGTCTCGAGCTCGGGCTGGGCATAAAAGTCAGGGC
AGAGCCATCTATTGCTTACATTTGCTTCTGGCGTGGCCACCATGGCTCCTAAGAAGAAGAGG
AAGGTGATGAGCCAGTTCGACATCCTGTGCAAGACCCCCCCCAAGGTGCTGGTGCGGCAGT
TCGTGGAGAGATTCGAGAGGCCCAGCGGCGAGAAGATCGCCAGCTGTGCCGCCGAGCTGA
CCTACCTGTGCTGGATGATCACCCACAACGGCACCGCCATCAAGAGGGCCACCTTCATGAG
CTACAACACCATCATCAGCAACAGCCTGAGCTTCGACATCGTGAACAAGAGCCTGCAGTTCA
AGTACAAGACCCAGAAGGCCACCATCCTGGAGGCCAGCCTGAAGAAGCTGATCCCCGCCTG
GGAGTTCACCATCATCCCTTACAACGGCCAGAAGCACCAGAGCGACATCACCGACATCGTGT
CCAGCCTGCAGCTGCAGTTCGAGAGCAGCGAGGAGGCCGACAAGGGCAACAGCCACAGCA
AGAAGATGCTGAAGGCCCTGCTGTCCGAGGGCGAGAGCATCTGGGAGATCACCGAGAAGAT
CCTGAACAGCTTCGAGTACACCAGCAGGTTCACCAAGACCAAGACCCTGTACCAGTTCCTGT
TCCTGGCCACATTCATCAACTGCGGCAGGTTCAGCGACATCAAGAACGTGGACCCCAAGAG
CTTCAAGCTGGTGCAGAACAAGTACCTGGGCGTGATCATTCAGTGCCTGGTGACCGAGACCA
AGACAAGCGTGTCCAGGCACATCTACTTTTTTCAGCGCCAGAGGCAGGATCGACCCCCTGGT
GTACCTGGACGAGTTCCTGAGGAACAGCGAGCCCGTGCTGAAGAGAGTGAACAGGACCGGC
AACAGCAGCAGCAACAAGCAGGAGTACCAGCTGCTGAAGGACAACCTGGTGCGCAGCTACA

| Fig 26 cont'd |
| --- |
| Vector ID (length between ITRs) & Sequence Between ITRs |
| ACAAGGCCCTGAAGAAGAACGCCCCCTACCCCATCTTCGCTATCAAGAACGGCCCTAAGAGC CACATCGGCAGGCACCTGATGACCAGCTTTCTGAGCATGAAGGGCCTGACCGAGCTGACAA ACGTGGTGGGCAACTGGAGCGACAAGAGGGCCTCCGCCGTGGCCAGGACCACCTACACCC ACCAGATCACCGCCATCCCCGACCACTACTTCGCCCTGGTGTCCAGGTACTACGCCTACGAC CCCATCAGCAAGGAGATGATCGCCCTGAAGGACGAGACCAACCCCATCGAGGAGTGGCAGC ACATCGAGCAGCTGAAGGGCAGCGCCGAGGGCAGCATCAGATACCCCGCCTGGAACGGCA TCATCAGCCAGGAGGTGCTGGACTACCTGAGCAGCTACATCAACAGGCGGATCTGAGAATTC GATATCAAGCTTATCGATAATCAACCTCTGGATTACAAAATTTGTGAAAGATTGACTGGTATTC TTAACTATGTTGCTCCTTTTACGCTATGTGGATACGCTGCTTTAATGCCTTTGTATCATGCTAT TGCTTCCCGTATGGCTTTCATTTTCTCCTCCTTGTATAAATCCTGGTTGCTGTCTCTTTATGAG GAGTTGTGGCCCGTTGTCAGGCAACGTGGCGTGGTGTGCACTGTGTTTGCTGACGCAACCC CCACTGGTTGGGGCATTGCCACCACCTGTCAGCTCCTTTCCGGGACTTTCGCTTTCCCCCTC CCTATTGCCACGGCGGAACTCATCGCCGCCTGCCTTGCCCGCTGCTGGACAGGGGCTCGGC TGTTGGGCACTGACAATTCCGTGGTGTTGTCGGGGAAATCATCGTCCTTTCCTTGGCTGCTC GCCTATGTTGCCACCTGGATTCTGCGCGGGACGTCCTTCTGCTACGTCCCTTCGGCCCTCAA TCCAGCGGACCTTCCTTCCCGCGGCCTGCTGCCGGCTCTGCGGCCTCTTCCGCGTCTTCGC CTTCGCCCTCAGACGAGTCGGATCTCCCTTTGGGCCGCCTCCCCGCATCGATACCGAGCGC TGCTCGAGAGATCTACGGGTGGCATCCCTGTGACCCCTCCCCAGTGCCTCTCCTGGCCCTG GAAGTTGCCACTCCAGTGCCCACCAGCCTTGTCCTAATAAAATTAAGTTGCATCATTTTGTCT GACTAGGTGTCCTTCTATAATATTATGGGGTGGAGGGGGGTGGTATGGAGCAAGGGGCAAG TTGGGAAGACAACCTGTAGGGCCTGCGGGGTCTATTGGGAACCAAGCTGGAGTGCAGTGGC ACAATCTTGGCTCACTGCAATCTCCGCCTCCTGGGTTCAAGCGATTCTCCTGCCTCAGCCTC CCGAGTTGTTGGGATTCCAGGCATGCATGACCAGGCTCAGCTAATTTTTGTTTTTTTGGTAGA GACGGGGTTTCACCATATTGGCCAGGCTGGTCTCCAACTCCTAATCTCAGGTGATCTACCCA CCTTGGCCTCCCAAATTGCTGGGATTACAGGCGTGAACCACTGCTCCCTTCCCTGTCCTTCT GATTTTGTAGGTAACCACGTGCGGACCGAGCGGCCGC (SEQ ID NO: 325) |
| 3044 (3061) GCGGCCGCACGCGTCCTCTCCTCCTCTTTGTTTTTCTTCTGCTGGCACAGGGCTGGGAGAGC CAGTTAACGCAGATGGTAGTGCAGAGAGTTCTCATGACCCCGGTTTTATTAGCTGGGGACCA GGACTTTCTAAATGTGCCCGTGTTTGATTGTATACTCATGTTGCCTGATTTAGCCACATTACTT CTGATTGCTTCTTAGTGATTTTCCCACTGAAATTTCTTTCCTATTGGTTTTGTAGAGGTATAGTT CACTCCCATCTCTATCTGAATGGCATTCTCCAACCCGAGAAGCATGCTGGGAACGTGGGCCA GGGAAAATGCGCTCCCCCATGCCACCATGCCCGCCTGAAGCCTGTGGTTTCACAGAGGATT CTTCGGTAGGCGCTGCTTGAGTTGTAGTCTGATGACGGTGACGCTTATGTTCCGGCTTCCCT ACAGTAACTCTTCTTGGCTGATTATTGCTAGAGAATCTCATTGGAGGAAAGAGGAAAAGACGG AAGCTGAGACCTGTTTGTGCTTCCCCTGAACGAGCTCGGGCTGGGCATAAAAGTCAGGGCA GAGCCATCTATTGCTTACATTTGCTTCTGGCGTGGCCACCATGGCTCCTAAGAAGAAGAGGA AGGTGATGAGCCAGTTCGACATCCTGTGCAAGACCCCCCCCAAGGTGCTGGTGCGGCAGTT CGTGGAGAGATTCGAGAGGCCCAGCGGCGAGAAGATCGCCAGCTGTGCCGCCGAGCTGAC CTACCTGTGCTGGATGATCACCCACAACGGCACCGCCATCAAGAGGGCCACCTTCATGAGCT ACAACACCATCATCAGCAACAGCCTGAGCTTCGACATCGTGAACAAGAGCCTGCAGTTCAAG TACAAGACCCAGAAGGCCACCATCCTGGAGGCCAGCCTGAAGAAGCTGATCCCCGCCTGGG AGTTCACCATCATCCCTTACAACGGCCAGAAGCACCAGAGCGACATCACCGACATCGTGTCC AGCCTGCAGCTGCAGTTCGAGAGCAGCGAGGAGGCCGACAAGGGCAACAGCCACAGCAAG AAGATGCTGAAGGCCCTGCTGTCCGAGGGCGAGAGCATCTGGGAGATCACCGAGAAGATCC TGAACAGCTTCGAGTACACCAGCAGGTTCACCAAGACCAAGACCCTGTACCAGTTCCTGTTC CTGGCCACATTCATCAACTGCGGCAGGTTCAGCGACATCAAGAACGTGGACCCCAAGAGCTT CAAGCTGGTGCAGAACAAGTACCTGGGCGTGATCATTCAGTGCCTGGTGACCGAGACCAAG ACAAGCGTGTCCAGGCACATCTACTTTTTCAGCGCCAGAGGCAGGATCGACCCCCTGGTGTA |

| Fig 26 cont'd |
|---|
| Vector ID (length between ITRs) & Sequence Between ITRs |
| CCTGGACGAGTTCCTGAGGAACAGCGAGCCCGTGCTGAAGAGAGTGAACAGGACCGGCAAC<br>AGCAGCAGCAACAAGCAGGAGTACCAGCTGCTGAAGGACAACCTGGTGCGCAGCTACAACA<br>AGGCCCTGAAGAAGAACGCCCCCTACCCCATCTTCGCTATCAAGAACGGCCCTAAGAGCCA<br>CATCGGCAGGCACCTGATGACCAGCTTTCTGAGCATGAAGGGCCTGACCGAGCTGACAAAC<br>GTGGTGGGCAACTGGAGCGACAAGAGGGCCTCCGCCGTGGCCAGGACCACCTACACCCAC<br>CAGATCACCGCCATCCCCGACCACTACTTCGCCCTGGTGTCCAGGTACTACGCCTACGACCC<br>CATCAGCAAGGAGATGATCGCCCTGAAGGACGAGACCAACCCCATCGAGGAGTGGCAGCAC<br>ATCGAGCAGCTGAAGGGCAGCGCCGAGGGCAGCATCAGATACCCCGCCTGGAACGGCATC<br>ATCAGCCAGGAGGTGCTGGACTACCTGAGCAGCTACATCAACAGGCGGATCTGAGAATTCG<br>ATATCAAGCTTATCGATAATCAACCTCTGGATTACAAAATTTGTGAAAGATTGACTGGTATTCT<br>TAACTATGTTGCTCCTTTTACGCTATGTGGATACGCTGCTTTAATGCCTTTGTATCATGCTATT<br>GCTTCCCGTATGGCTTTCATTTTCTCCTCCTTGTATAAATCCTGGTTGCTGTCTCTTTATGAGG<br>AGTTGTGGCCCGTTGTCAGGCAACGTGGCGTGGTGTGCACTGTGTTTGCTGACGCAACCCC<br>CACTGGTTGGGGCATTGCCACCACCTGTCAGCTCCTTTCCGGGACTTTCGCTTTCCCCCTCC<br>CTATTGCCACGGCGGAACTCATCGCCGCCTGCCTTGCCCGCTGCTGGACAGGGGCTCGGCT<br>GTTGGGCACTGACAATTCCGTGGTGTTGTCGGGGAAATCATCGTCCTTTCCTTGGCTGCTCG<br>CCTATGTTGCCACCTGGATTCTGCGCGGGACGTCCTTCTGCTACGTCCCTTCGGCCCTCAAT<br>CCAGCGGACCTTCCTTCCCGCGGCCTGCTGCCGGCTCTGCGGCCTCTTCCGCGTCTTCGCC<br>TTCGCCCTCAGACGAGTCGGATCTCCCTTTGGGCCGCCTCCCCGCATCGATACCGAGCGCT<br>GCTCGAGAGATCTACGGGTGGCATCCCTGTGACCCCTCCCCAGTGCCTCTCCTGGCCCTGG<br>AAGTTGCCACTCCAGTGCCCACCAGCCTTGTCCTAATAAAATTAAGTTGCATCATTTTGTCTG<br>ACTAGGTGTCCTTCTATAATATTATGGGGTGGAGGGGGGTGGTATGGAGCAAGGGGCAAGTT<br>GGGAAGACAACCTGTAGGGCCTGCGGGGTCTATTGGGAACCAAGCTGGAGTGCAGTGGCAC<br>AATCTTGGCTCACTGCAATCTCCGCCTCCTGGGTTCAAGCGATTCTCCTGCCTCAGCCTCCC<br>GAGTTGTTGGGATTCCAGGCATGCATGACCAGGCTCAGCTAATTTTTGTTTTTTTGGTAGAGA<br>CGGGGTTTCACCATATTGGCCAGGCTGGTCTCCAACTCCTAATCTCAGGTGATCTACCCACC<br>TTGGCCTCCCAAATTGCTGGGATTACAGGCGTGAACCACTGCTCCCTTCCCTGTCCTTCTGA<br>TTTTGTAGGTAACCACGTGCGGACCGAGCGGCCGC (SEQ ID NO: 326) |
| 3045 (2910)<br>GCGGCCGCACGCGTTGTGTCAGGCTGGCAAGTTAGTGAACCTCACCTCCCGGTCCCTGCTA<br>CCCTGGCTTCCAGTGTCCTGCGGCTTCTGCCAGCCTTTGCATTTTTCTCTTTTTCTCATTGCG<br>TGGCCCCCTTGTCTTTAAAAGGCTAAACTGCTCTGTACTAAATTTGGTCACGCAGCGCTCCAA<br>GATTCCCTGGAATGTCCTCAAGTTTCAAACAGCTCTGACCGTGAGGCAGGCCCGCCCCCTG<br>GCTTGGGGATTGGCTTCTCCTCTGTGGCTGGGCAGCTGTCAGGTTTTATTGGTTGCTGGTTA<br>GACCAAGCAGGGTCCACTAGCAGGGAGGCTGCTGTGTCCCCCGGAGCACCTGTAGTACAGC<br>AGGGCCCAAAGAGCTCGGGCTGGGCATAAAAGTCAGGGCAGAGCCATCTATTGCTTACATTT<br>GCTTCTGGCGTGGCCACCATGGCTCCTAAGAAGAAGAGGAAGGTGATGAGCCAGTTCGACA<br>TCCTGTGCAAGACCCCCCCCAAGGTGCTGGTGCGGCAGTTCGTGGAGAGATTCGAGAGGCC<br>CAGCGGCGAGAAGATCGCCAGCTGTGCCGCCGAGCTGACCTACCTGTGCTGGATGATCACC<br>CACAACGGCACCGCCATCAAGAGGGCCACCTTCATGAGCTACAACACCATCATCAGCAACAG<br>CCTGAGCTTCGACATCGTGAACAAGAGCCTGCAGTTCAAGTACAAGACCCAGAAGGCCACCA<br>TCCTGGAGGCCAGCCTGAAGAAGCTGATCCCCGCCTGGGAGTTCACCATCATCCCTTACAAC<br>GGCCAGAAGCACCAGAGCGACATCACCGACATCGTGTCCAGCCTGCAGCTGCAGTTCGAGA<br>GCAGCGAGGAGGCCGACAAGGGCAACAGCCACAGCAAGAAGATGCTGAAGGCCCTGCTGT<br>CCGAGGGCGAGAGCATCTGGGAGATCACCGAGAAGATCCTGAACAGCTTCGAGTACACCAG<br>CAGGTTCACCAAGACCAAGACCCTGTACCAGTTCCTGTTCCTGGCCACATTCATCAACTGCG<br>GCAGGTTCAGCGACATCAAGAACGTGGACCCCAAGAGCTTCAAGCTGGTGCAGAACAAGTA<br>CCTGGGCGTGATCATTCAGTGCCTGGTGACCGAGACCAAGACAAGCGTGTCCAGGCACATC<br>TACTTTTTCAGCGCCAGAGGCAGGATCGACCCCCTGGTGTACCTGGACGAGTTCCTGAGGAA |

| Fig 26 cont'd |
| Vector ID (length between ITRs) & Sequence Between ITRs |
| CAGCGAGCCCGTGCTGAAGAGAGTGAACAGGACCGGCAACAGCAGCAGCAACAAGCAGGA<br>GTACCAGCTGCTGAAGGACAACCTGGTGCGCAGCTACAACAAGGCCCTGAAGAAGAACGCC<br>CCCTACCCCATCTTCGCTATCAAGAACGGCCCTAAGAGCCACATCGGCAGGCACCTGATGAC<br>CAGCTTTCTGAGCATGAAGGGCCTGACCGAGCTGACAAACGTGGTGGGCAACTGGAGCGAC<br>AAGAGGGCCTCCGCCGTGGCCAGGACCACCTACACCCACCAGATCACCGCCATCCCCGACC<br>ACTACTTCGCCCTGGTGTCCAGGTACTACGCCTACGACCCCATCAGCAAGGAGATGATCGCC<br>CTGAAGGACGAGACCAACCCCATCGAGGAGTGGCAGCACATCGAGCAGCTGAAGGGCAGC<br>GCCGAGGGCAGCATCAGATACCCCGCCTGGAACGGCATCATCAGCCAGGAGGTGCTGGACT<br>ACCTGAGCAGCTACATCAACAGGCGGATCTGAGAATTCGATATCAAGCTTATCGATAATCAAC<br>CTCTGGATTACAAAATTTGTGAAAGATTGACTGGTATTCTTAACTATGTTGCTCCTTTTACGCT<br>ATGTGGATACGCTGCTTTAATGCCTTTGTATCATGCTATTGCTTCCCGTATGGCTTTCATTTTC<br>TCCTCCTTGTATAAATCCTGGTTGCTGTCTCTTTATGAGGAGTTGTGGCCCGTTGTCAGGCAA<br>CGTGGCGTGGTGTGCACTGTGTTTGCTGACGCAACCCCCACTGGTTGGGGCATTGCCACCA<br>CCTGTCAGCTCCTTTCCGGGACTTTCGCTTTCCCCCTCCCTATTGCCACGGCGGAACTCATC<br>GCCGCCTGCCTTGCCCGCTGCTGGACAGGGGCTCGGCTGTTGGGCACTGACAATTCCGTGG<br>TGTTGTCGGGGAAATCATCGTCCTTTCCTTGGCTGCTCGCCTATGTTGCCACCTGGATTCTG<br>CGCGGGACGTCCTTCTGCTACGTCCCTTCGGCCCTCAATCCAGCGGACCTTCCTTCCCGCG<br>GCCTGCTGCCGGCTCTGCGGCCTCTTCCGCGTCTTCGCCTTCGCCCTCAGACGAGTCGGAT<br>CTCCCTTTGGGCCGCCTCCCCGCATCGATACCGAGCGCTGCTCGAGAGATCTACGGGTGGC<br>ATCCCTGTGACCCCTCCCCAGTGCCTCTCCTGGCCCTGGAAGTTGCCACTCCAGTGCCCAC<br>CAGCCTTGTCCTAATAAAATTAAGTTGCATCATTTTGTCTGACTAGGTGTCCTTCTATAATATT<br>ATGGGGTGGAGGGGGGTGGTATGGAGCAAGGGGCAAGTTGGGAAGACAACCTGTAGGGCC<br>TGCGGGGTCTATTGGGAACCAAGCTGGAGTGCAGTGGCACAATCTTGGCTCACTGCAATCTC<br>CGCCTCCTGGGTTCAAGCGATTCTCCTGCCTCAGCCTCCCGAGTTGTTGGGATTCCAGGCAT<br>GCATGACCAGGCTCAGCTAATTTTTGTTTTTTTGGTAGAGACGGGGTTTCACCATATTGGCCA<br>GGCTGGTCTCCAACTCCTAATCTCAGGTGATCTACCCACCTTGGCCTCCCAAATTGCTGGGA<br>TTACAGGCGTGAACCACTGCTCCCTTCCCTGTCCTTCTGATTTTGTAGGTAACCACGTGCGG<br>ACCGAGCGGCCGC (SEQ ID NO: 327) |
| 3046 (2931)<br>GCGGCCGCACGCGTAGGAAGGCTGGGGTTGTCTTAACATAAACACAGCTTAAAGGAACTATT<br>CTCAAATCTCTCTCCTTTCTGACCAGCTACCTAAGTCATCAAGACAAACTCTTCAACTGGCAG<br>AAAGCTGGCCTAGCCTCACTATGCCTCCCAGCACACTGCCTTCTGGGGCAGCAAGTGCCTG<br>GGAACATCGTAGAAGCACATTCCCAGGACCTGCTGGGCTAAGGCTTCACCTCACATGGTCAC<br>CATCAGGCCGGGTTCAGGCCCCTCGGGGCTCTGCTTTTAGCAGCAATGGGAAAGAGGCACA<br>GGGTAAGAGAGTCAGAGGGCGATAGGCAGGTCTGCAAAGCAAACACTCAGAAAATTAGAAAT<br>AGCTCAAGAAACAAATGCCCTGAGAAAGTATGAGCTCGGGCTGGGCATAAAAGTCAGGGCA<br>GAGCCATCTATTGCTTACATTTGCTTCTGGCGTGGCCACCATGGCTCCTAAGAAGAAGAGGA<br>AGGTGATGAGCCAGTTCGACATCCTGTGCAAGACCCCCCCCAAGGTGCTGGTGCGGCAGTT<br>CGTGGAGAGATTCGAGAGGCCCAGCGGCGAGAAGATCGCCAGCTGTGCCGCCGAGCTGAC<br>CTACCTGTGCTGGATGATCACCCACAACGGCACCGCCATCAAGAGGGCCACCTTCATGAGCT<br>ACAACACCATCATCAGCAACAGCCTGAGCTTCGACATCGTGAACAAGAGCCTGCAGTTCAAG<br>TACAAGACCCAGAAGGCCACCATCCTGGAGGCCAGCCTGAAGAAGCTGATCCCCGCCTGGG<br>AGTTCACCATCATCCCTTACAACGGCCAGAAGCACCAGAGCGACATCACCGACATCGTGTCC<br>AGCCTGCAGCTGCAGTTCGAGAGCAGCGAGGAGGCCGACAAGGGCAACAGCCACAGCAAG<br>AAGATGCTGAAGGCCCTGCTGTCCGAGGGCGAGAGCATCTGGGAGATCACCGAGAAGATCC<br>TGAACAGCTTCGAGTACACCAGCAGGTTCACCAAGACCAAGACCCTGTACCAGTTCCTGTTC<br>CTGGCCACATTCATCAACTGCGGCAGGTTCAGCGACATCAAGAACGTGGACCCCAAGAGCTT<br>CAAGCTGGTGCAGAACAAGTACCTGGGCGTGATCATTCAGTGCCTGGTGACCGAGACCAAG<br>ACAAGCGTGTCCAGGCACATCTACTTTTTCAGCGCCAGAGGCAGGATCGACCCCCTGGTGTA |

| Fig 26 cont'd |
|---|
| Vector ID (length between ITRs) & Sequence Between ITRs |
| CCTGGACGAGTTCCTGAGGAACAGCGAGCCCGTGCTGAAGAGAGTGAACAGGACCGGCAAC<br>AGCAGCAGCAACAAGCAGGAGTACCAGCTGCTGAAGGACAACCTGGTGCGCAGCTACAACA<br>AGGCCCTGAAGAAGAACGCCCCCTACCCCATCTTCGCTATCAAGAACGGCCCTAAGAGCCA<br>CATCGGCAGGCACCTGATGACCAGCTTTCTGAGCATGAAGGGCCTGACCGAGCTGACAAAC<br>GTGGTGGGCAACTGGAGCGACAAGAGGGCCTCCGCCGTGGCCAGGACCACCTACACCCAC<br>CAGATCACCGCCATCCCCGACCACTACTTCGCCCTGGTGTCCAGGTACTACGCCTACGACCC<br>CATCAGCAAGGAGATGATCGCCCTGAAGGACGAGACCAACCCCATCGAGGAGTGGCAGCAC<br>ATCGAGCAGCTGAAGGGCAGCGCCGAGGGCAGCATCAGATACCCCGCCTGGAACGGCATC<br>ATCAGCCAGGAGGTGCTGGACTACCTGAGCAGCTACATCAACAGGCGGATCTGAGAATTCG<br>ATATCAAGCTTATCGATAATCAACCTCTGGATTACAAAATTTGTGAAAGATTGACTGGTATTCT<br>TAACTATGTTGCTCCTTTTACGCTATGTGGATACGCTGCTTTAATGCCTTTGTATCATGCTATT<br>GCTTCCCGTATGGCTTTCATTTTCTCCTCCTTGTATAAATCCTGGTTGCTGTCTCTTTATGAGG<br>AGTTGTGGCCCGTTGTCAGGCAACGTGGCGTGGTGTGCACTGTGTTTGCTGACGCAACCCC<br>CACTGGTTGGGGCATTGCCACCACCTGTCAGCTCCTTTCCGGGACTTTCGCTTTCCCCCTCC<br>CTATTGCCACGGCGGAACTCATCGCCGCCTGCCTTGCCCGCTGCTGGACAGGGGCTCGGCT<br>GTTGGGCACTGACAATTCCGTGGTGTTGTCGGGGAAATCATCGTCCTTTCCTTGGCTGCTCG<br>CCTATGTTGCCACCTGGATTCTGCGCGGGACGTCCTTCTGCTACGTCCCTTCGGCCCTCAAT<br>CCAGCGGACCTTCCTTCCCGCGGCCTGCTGCCGGCTCTGCGGCCTCTTCCGCGTCTTCGCC<br>TTCGCCCTCAGACGAGTCGGATCTCCCTTTGGGCCGCCTCCCCGCATCGATACCGAGCGCT<br>GCTCGAGAGATCTACGGGTGGCATCCCTGTGACCCCTCCCCAGTGCCTCTCCTGGCCCTGG<br>AAGTTGCCACTCCAGTGCCCACCAGCCTTGTCCTAATAAAATTAAGTTGCATCATTTTGTCTG<br>ACTAGGTGTCCTTCTATAATATTATGGGGTGGAGGGGGGTGGTATGGAGCAAGGGGCAAGTT<br>GGGAAGACAACCTGTAGGGCCTGCGGGGTCTATTGGGAACCAAGCTGGAGTGCAGTGGCAC<br>AATCTTGGCTCACTGCAATCTCCGCCTCCTGGGTTCAAGCGATTCTCCTGCCTCAGCCTCCC<br>GAGTTGTTGGGATTCCAGGCATGCATGACCAGGCTCAGCTAATTTTTGTTTTTTTGGTAGAGA<br>CGGGGTTTCACCATATTGGCCAGGCTGGTCTCCAACTCCTAATCTCAGGTGATCTACCCACC<br>TTGGCCTCCCAAATTGCTGGGATTACAGGCGTGAACCACTGCTCCCTTCCCTGTCCTTCTGA<br>TTTTGTAGGTAACCACGTGCGGACCGAGCGGCCGC (SEQ ID NO: 328) |
| 3047 (3205)<br>GCGGCCGCACGCGTCATTGTGAAACACACCACACATTGCATGGCAGCCCCAGCAGAGTCCT<br>AGGTATTCCCCAAGGACCAAATGTACTAATGTTTTTCTGCAGAGAAACATAGGACAACTCACA<br>CGCTAGAGAAAAAAATTACAAAGGTTACAAATAGCTTTCTCTCGGGATTTGCTGCCAGACCAG<br>TTGAGAGCATATAAGGTCAGGTTCTTGCTCTGCAAGGTCCCAAGTTCCAAGTTTTGAGAGGTT<br>TGGGATTTTGCAATTGGGGGGTAAAAGGGTATTGACCCACTGTACAAATGACTTTTCCCTGGTA<br>TTCCCATTGGGTCCTAGCACTTACTTCAAAGACCTTACACATTCTCGGGGGGGGGGGCCCTC<br>TGCAGGGGCAACAAGCACCAGTTTGTTACTCCAACAGCAGAAGCCATGGGAAAATTCCTCAG<br>AGCAGCAAAGCTGCCCCTTCCAGCTCTCTGTCACAGAGAGTGCTGCCCTTTCCTGCTCCTAG<br>GACGCGGCACTTATGGCCATGATGACATCATCATTTAAGATAGTCACTAACTGACCCACACTG<br>TTACCATCCTGACCCACTCCTCAACCATCCTAGTAAACCTCTCTTGATAATGGATTAGGCAAA<br>GAGAGTGTACTCCGCTGTTACCCAGAAACCTCAGGGAGAGAGATCAAATGAGCTCGGGC<br>TGGGCATAAAAGTCAGGGCAGAGCCATCTATTGCTTACATTTGCTTCTGGCGTGGCCACCAT<br>GGCTCCTAAGAAGAAGAGGAAGGTGATGAGCCAGTTCGACATCCTGTGCAAGACCCCCCCC<br>AAGGTGCTGGTGCGGCAGTTCGTGGAGAGATTCGAGAGGCCCAGCGGCGAGAAGATCGCC<br>AGCTGTGCCGCCGAGCTGACCTACCTGTGCTGGATGATCACCCACAACGGCACCGCCATCA<br>AGAGGGCCACCTTCATGAGCTACAACACCATCATCAGCAACAGCCTGAGCTTCGACATCGTG<br>AACAAGAGCCTGCAGTTCAAGTACAAGACCCAGAAGGCCACCATCCTGGAGGCCAGCCTGA<br>AGAAGCTGATCCCCGCCTGGGAGTTCACCATCATCCCTTACAACGGCCAGAAGCACCAGAG<br>CGACATCACCGACATCGTGTCCAGCCTGCAGCTGCAGTTCGAGAGCAGCGAGGAGGCCGAC<br>AAGGGCAACAGCCACAGCAAGAAGATGCTGAAGGCCCTGCTGTCCGAGGGCGAGAGCATCT |

| Fig 26 cont'd |
|---|
| Vector ID (length between ITRs) & Sequence Between ITRs |

GGGAGATCACCGAGAAGATCCTGAACAGCTTCGAGTACACCAGCAGGTTCACCAAGACCAA
GACCCTGTACCAGTTCCTGTTCCTGGCCACATTCATCAACTGCGGCAGGTTCAGCGACATCA
AGAACGTGGACCCCAAGAGCTTCAAGCTGGTGCAGAACAAGTACCTGGGCGTGATCATTCA
GTGCCTGGTGACCGAGACCAAGACAAGCGTGTCCAGGCACATCTACTTTTTCAGCGCCAGA
GGCAGGATCGACCCCCTGGTGTACCTGGACGAGTTCCTGAGGAACAGCGAGCCCGTGCTGA
AGAGAGTGAACAGGACCGGCAACAGCAGCAGCAACAAGCAGGAGTACCAGCTGCTGAAGGA
CAACCTGGTGCGCAGCTACAACAAGGCCCTGAAGAAGAACGCCCCCTACCCCATCTTCGCTA
TCAAGAACGGCCCTAAGAGCCACATCGGCAGGCACCTGATGACCAGCTTTCTGAGCATGAA
GGGCCTGACCGAGCTGACAAACGTGGTGGGCAACTGGAGCGACAAGAGGGCCTCCGCCGT
GGCCAGGACCACCTACACCCACCAGATCACCGCCATCCCCGACCACTACTTCGCCCTGGTG
TCCAGGTACTACGCCTACGACCCCATCAGCAAGGAGATGATCGCCCTGAAGGACGAGACCA
ACCCCATCGAGGAGTGGCAGCACATCGAGCAGCTGAAGGGCAGCGCCGAGGGCAGCATCA
GATACCCCGCCTGGAACGGCATCATCAGCCAGGAGGTGCTGGACTACCTGAGCAGCTACAT
CAACAGGCGGATCTGAGAATTCGATATCAAGCTTATCGATAATCAACCTCTGGATTACAAAAT
TTGTGAAAGATTGACTGGTATTCTTAACTATGTTGCTCCTTTTACGCTATGTGGATACGCTGCT
TTAATGCCTTTGTATCATGCTATTGCTTCCCGTATGGCTTTCATTTTCTCCTCCTTGTATAAATC
CTGGTTGCTGTCTCTTTATGAGGAGTTGTGGCCCGTTGTCAGGCAACGTGGCGTGGTGTGCA
CTGTGTTTGCTGACGCAACCCCCACTGGTTGGGGCATTGCCACCACCTGTCAGCTCCTTTCC
GGGACTTTCGCTTTCCCCCTCCCTATTGCCACGGCGGAACTCATCGCCGCCTGCCTTGCCC
GCTGCTGGACAGGGGCTCGGCTGTTGGGCACTGACAATTCCGTGGTGTTGTCGGGGAAATC
ATCGTCCTTTCCTTGGCTGCTCGCCTATGTTGCCACCTGGATTCTGCGCGGGACGTCCTTCT
GCTACGTCCCTTCGGCCCTCAATCCAGCGGACCTTCCTTCCCGCGGCCTGCTGCCGGCTCT
GCGGCCTCTTCCGCGTCTTCGCCTTCGCCCTCAGACGAGTCGGATCTCCCTTTGGGCCGCC
TCCCCGCATCGATACCGAGCGCTGCTCGAGAGATCTACGGGTGGCATCCCTGTGACCCCTC
CCCAGTGCCTCTCCTGGCCCTGGAAGTTGCCACTCCAGTGCCCACCAGCCTTGTCCTAATAA
AATTAAGTTGCATCATTTTGTCTGACTAGGTGTCCTTCTATAATATTATGGGGTGGAGGGGGG
TGGTATGGAGCAAGGGGCAAGTTGGGAAGACAACCTGTAGGGCCTGCGGGGTCTATTGGGA
ACCAAGCTGGAGTGCAGTGGCACAATCTTGGCTCACTGCAATCTCCGCCTCCTGGGTTCAAG
CGATTCTCCTGCCTCAGCCTCCCGAGTTGTTGGGATTCCAGGCATGCATGACCAGGCTCAGC
TAATTTTTGTTTTTTTGGTAGAGACGGGGTTTCACCATATTGGCCAGGCTGGTCTCCAACTCC
TAATCTCAGGTGATCTACCCACCTTGGCCTCCCAAATTGCTGGGATTACAGGCGTGAACCAC
TGCTCCCTTCCCTGTCCTTCTGATTTTGTAGGTAACCACGTGCGGACCGAGCGGCCGC (SEQ
ID NO: 329)

3048 (2985)
GCGGCCGCACGCGTTTTTCTTCCAAACGGCTATGTGTCTGTACATGGACTAACTTATATGATC
ACCTGTCCAGACTCACAAGCCTTCAGCCCTCCCCAGCCTCCCTACGGCTGCCACACTGGCC
AGGAGGGGCTCTTCTGGGCAATCTGGCCCTGGTCCCGGCAGCATGACGCTGAGCAAGGCA
GGGGTGTGGAGAGCTAGTCTGTGTACCCTTCAAGGGCAGCCAGAGACAGGAGGTGGAGCCT
CAGCTGGCCAGCAGGTCCCACAGGCCACTGTTGCAGGGCAGCAGGTCACATGCTAGGCGT
GCTTTGCGATCCCGGACGGCCTTCAGGGCTGGGCTGTGTTGTAACAGGAGGGAGCAAATGT
CCTCGTGACCCTTCTCCGCAGCCTGGGGGGGGGGGTTGTGGGGGGGAGGGAGGGAGAGA
GAGAGAGAGAGAGAGAGAGAGAGAGGAGCTCGGGCTGGGCATAAAAGTCAGGGC
AGAGCCATCTATTGCTTACATTTGCTTCTGGCGTGGCCACCATGGCTCCTAAGAAGAAGAGG
AAGGTGATGAGCCAGTTCGACATCCTGTGCAAGACCCCCCCCAAGGTGCTGGTGCGGCAGT
TCGTGGAGAGATTCGAGAGGCCCAGCGGCGAGAAGATCGCCAGCTGTGCCGCCGAGCTGA
CCTACCTGTGCTGGATGATCACCCACAACGGCACCGCCATCAAGAGGGCCACCTTCATGAG
CTACAACACCATCATCAGCAACAGCCTGAGCTTCGACATCGTGAACAAGAGCCTGCAGTTCA
AGTACAAGACCCAGAAGGCCACCATCCTGGAGGCCAGCCTGAAGAAGCTGATCCCCGCCTG
GGAGTTCACCATCATCCCTTACAACGGCCAGAAGCACCAGAGCGACATCACCGACATCGTGT

| Fig 26 cont'd |
| --- |
| Vector ID (length between ITRs) & Sequence Between ITRs |
| CCAGCCTGCAGCTGCAGTTCGAGAGCAGCGAGGAGGCCGACAAGGGCAACAGCCACAGCA AGAAGATGCTGAAGGCCCTGCTGTCCGAGGGCGAGAGCATCTGGGAGATCACCGAGAAGAT CCTGAACAGCTTCGAGTACACCAGCAGGTTCACCAAGACCAAGACCCTGTACCAGTTCCTGT TCCTGGCCACATTCATCAACTGCGGCAGGTTCAGCGACATCAAGAACGTGGACCCCAAGAG CTTCAAGCTGGTGCAGAACAAGTACCTGGGCGTGATCATTCAGTGCCTGGTGACCGAGACCA AGACAAGCGTGTCCAGGCACATCTACTTTTTCAGCGCCAGAGGCAGGATCGACCCCCTGGT GTACCTGGACGAGTTCCTGAGGAACAGCGAGCCCGTGCTGAAGAGAGTGAACAGGACCGGC AACAGCAGCAGCAACAAGCAGGAGTACCAGCTGCTGAAGGACAACCTGGTGCGCAGCTACA ACAAGGCCCTGAAGAAGAACGCCCCCTACCCCATCTTCGCTATCAAGAACGGCCCTAAGAGC CACATCGGCAGGCACCTGATGACCAGCTTTCTGAGCATGAAGGGCCTGACCGAGCTGACAA ACGTGGTGGGCAACTGGAGCGACAAGAGGGCCTCCGCCGTGGCCAGGACCACCTACACCC ACCAGATCACCGCCATCCCCGACCACTACTTCGCCCTGGTGTCCAGGTACTACGCCTACGAC CCCATCAGCAAGGAGATGATCGCCCTGAAGGACGAGACCAACCCCATCGAGGAGTGGCAGC ACATCGAGCAGCTGAAGGGCAGCGCCGAGGGCAGCATCAGATACCCCGCCTGGAACGGCA TCATCAGCCAGGAGGTGCTGGACTACCTGAGCAGCTACATCAACAGGCGGATCTGAGAATTC GATATCAAGCTTATCGATAATCAACCTCTGGATTACAAAATTTGTGAAAGATTGACTGGTATTC TTAACTATGTTGCTCCTTTTACGCTATGTGGATACGCTGCTTTAATGCCTTTGTATCATGCTAT TGCTTCCCGTATGGCTTTCATTTTCTCCTCCTTGTATAAATCCTGGTTGCTGTCTCTTTATGAG GAGTTGTGGCCCGTTGTCAGGCAACGTGGCGTGGTGTGCACTGTGTTTGCTGACGCAACCC CCACTGGTTGGGGCATTGCCACCACCTGTCAGCTCCTTTCCGGGACTTTCGCTTTCCCCCTC CCTATTGCCACGGCGGAACTCATCGCCGCCTGCCTTGCCCGCTGCTGGACAGGGGCTCGGC TGTTGGGCACTGACAATTCCGTGGTGTTGTCGGGGAAATCATCGTCCTTTCCTTGGCTGCTC GCCTATGTTGCCACCTGGATTCTGCGCGGGACGTCCTTCTGCTACGTCCCTTCGGCCCTCAA TCCAGCGGACCTTCCTTCCCGCGGCCTGCTGCCGGCTCTGCGGCCTCTTCCGCGTCTTCGC CTTCGCCCTCAGACGAGTCGGATCTCCCTTTGGGCCGCCTCCCCGCATCGATACCGAGCGC TGCTCGAGAGATCTACGGGTGGCATCCCTGTGACCCCTCCCCAGTGCCTCTCCTGGCCCTG GAAGTTGCCACTCCAGTGCCCACCAGCCTTGTCCTAATAAAATTAAGTTGCATCATTTTGTCT GACTAGGTGTCCTTCTATAATATTATGGGGTGGAGGGGGGTGGTATGGAGCAAGGGGCAAG TTGGGAAGACAACCTGTAGGGCCTGCGGGGTCTATTGGGAACCAAGCTGGAGTGCAGTGGC ACAATCTTGGCTCACTGCAATCTCCGCCTCCTGGGTTCAAGCGATTCTCCTGCCTCAGCCTC CCGAGTTGTTGGGATTCCAGGCATGCATGACCAGGCTCAGCTAATTTTTGTTTTTTTGGTAGA GACGGGGTTTCACCATATTGGCCAGGCTGGTCTCCAACTCCTAATCTCAGGTGATCTACCCA CCTTGGCCTCCCAAATTGCTGGGATTACAGGCGTGAACCACTGCTCCCTTCCCTGTCCTTCT GATTTTGTAGGTAACCACGTGCGGACCGAGCGGCCGC (SEQ ID NO: 330) |
| 3049 (3059) GCGGCCGCACGCGTAAATTCTGTGTTGTAGAGTTTATTTTCCTTCAGTGTGATAGTCAGGGTC TGAGCCTGCCTCACAGTGAGCATGGAGGGCAGTTACAGCCAGCATGGACGACCTCTGTCCT GACTGGAATGTGGCTCTGGAAGGTTTTTTTTGTTTGTTTGTTTTTTTGGCTTCTGCTTCTATGC CACGACTCTTGTACCCAGTGTAGAGAACTTGGTGTTTCCCCTGGGGGTGCTACACATCACCC CTCTCCTAGATTCTGGCCTCGTCCCCTTCTCAAGGTCATCAGCACTAGGGCAGGCTTCTATTT AACCTTGGACTTAATTCTAGAAGCCATGCCTCTCCCTTCTTGACTTGTTGCCATTAAAGGCAC TTTGCAAAGCTTCTTCGGTTCCCTGGCAATCTTGCAGCAGCCTGGGGGAGCCCTTGTCTTAG CTGCTCCTGCCTTCTGCCCTCCTTTCTCTAAAGTTTTCTTTCTCAGCGCCCTTCTCTCTGAGA CAAGGCTGCTCTAGGGCAGTCCTCCCCTCGAGCTCGGGCTGGGCATAAAAGTCAGGGCAGA GCCATCTATTGCTTACATTTGCTTCTGGCGTGGCCACCATGGCTCCTAAGAAGAAGAGGAAG GTGATGAGCCAGTTCGACATCCTGTGCAAGACCCCCCCCAAGGTGCTGGTGCGGCAGTTCG TGGAGAGATTCGAGAGGCCCAGCGGCGAGAAGATCGCCAGCTGTGCCGCCGAGCTGACCT ACCTGTGCTGGATGATCACCCACAACGGCACCGCCATCAAGAGGGCCACCTTCATGAGCTA CAACACCATCATCAGCAACAGCCTGAGCTTCGACATCGTGAACAAGAGCCTGCAGTTCAAGT |

| Fig 26 cont'd |
| :--- |
| Vector ID (length between ITRs) & Sequence Between ITRs |
| ACAAGACCCAGAAGGCCACCATCCTGGAGGCCAGCCTGAAGAAGCTGATCCCCGCCTGGGA GTTCACCATCATCCCTTACAACGGCCAGAAGCACCAGAGCGACATCACCGACATCGTGTCCA GCCTGCAGCTGCAGTTCGAGAGCAGCGAGGAGGCCGACAAGGGCAACAGCCACAGCAAGA AGATGCTGAAGGCCCTGCTGTCCGAGGGCGAGAGCATCTGGGAGATCACCGAGAAGATCCT GAACAGCTTCGAGTACACCAGCAGGTTCACCAAGACCAAGACCCTGTACCAGTTCCTGTTCC TGGCCACATTCATCAACTGCGGCAGGTTCAGCGACATCAAGAACGTGGACCCCAAGAGCTTC AAGCTGGTGCAGAACAAGTACCTGGGCGTGATCATTCAGTGCCTGGTGACCGAGACCAAGA CAAGCGTGTCCAGGCACATCTACTTTTTCAGCGCCAGAGGCAGGATCGACCCCCTGGTGTAC CTGGACGAGTTCCTGAGGAACAGCGAGCCCGTGCTGAAGAGAGTGAACAGGACCGGCAACA GCAGCAGCAACAAGCAGGAGTACCAGCTGCTGAAGGACAACCTGGTGCGCAGCTACAACAA GGCCCTGAAGAAGAACGCCCCCTACCCCATCTTCGCTATCAAGAACGGCCCTAAGAGCCAC ATCGGCAGGCACCTGATGACCAGCTTTCTGAGCATGAAGGGCCTGACCGAGCTGACAAACG TGGTGGGCAACTGGAGCGACAAGAGGGCCTCCGCCGTGGCCAGGACCACCTACACCCACC AGATCACCGCCATCCCCGACCACTACTTCGCCCTGGTGTCCAGGTACTACGCCTACGACCCC ATCAGCAAGGAGATGATCGCCCTGAAGGACGAGACCAACCCCATCGAGGAGTGGCAGCACA TCGAGCAGCTGAAGGGCAGCGCCGAGGGCAGCATCAGATACCCCGCCTGGAACGGCATCA TCAGCCAGGAGGTGCTGGACTACCTGAGCAGCTACATCAACAGGCGGATCTGAGAATTCGAT ATCAAGCTTATCGATAATCAACCTCTGGATTACAAAATTTGTGAAAGATTGACTGGTATTCTTA ACTATGTTGCTCCTTTTACGCTATGTGGATACGCTGCTTTAATGCCTTTGTATCATGCTATTGC TTCCCGTATGGCTTTCATTTTCTCCTCCTTGTATAAATCCTGGTTGCTGTCTCTTTATGAGGAG TTGTGGCCCGTTGTCAGGCAACGTGGCGTGGTGTGCACTGTGTTTGCTGACGCAACCCCCA CTGGTTGGGGCATTGCCACCACCTGTCAGCTCCTTTCCGGGACTTTCGCTTTCCCCCTCCCT ATTGCCACGGCGGAACTCATCGCCGCCTGCCTTGCCCGCTGCTGGACAGGGGCTCGGCTGT TGGGCACTGACAATTCCGTGGTGTTGTCGGGGAAATCATCGTCCTTTCCTTGGCTGCTCGCC TATGTTGCCACCTGGATTCTGCGCGGGACGTCCTTCTGCTACGTCCCTTCGGCCCTCAATCC AGCGGACCTTCCTTCCCGCGGCCTGCTGCCGGCTCTGCGGCCTCTTCCGCGTCTTCGCCTT CGCCCTCAGACGAGTCGGATCTCCCTTTGGGCCGCCTCCCCGCATCGATACCGAGCGCTGC TCGAGAGATCTACGGGTGGCATCCCTGTGACCCCTCCCCAGTGCCTCTCCTGGCCCTGGAA GTTGCCACTCCAGTGCCCACCAGCCTTGTCCTAATAAAATTAAGTTGCATCATTTTGTCTGAC TAGGTGTCCTTCTATAATATTATGGGGTGGAGGGGGGTGGTATGGAGCAAGGGGCAAGTTG GGAAGACAACCTGTAGGGCCTGCGGGGTCTATTGGGAACCAAGCTGGAGTGCAGTGGCACA ATCTTGGCTCACTGCAATCTCCGCCTCCTGGGTTCAAGCGATTCTCCTGCCTCAGCCTCCCG AGTTGTTGGGATTCCAGGCATGCATGACCAGGCTCAGCTAATTTTTGTTTTTTTGGTAGAGAC GGGGTTTCACCATATTGGCCAGGCTGGTCTCCAACTCCTAATCTCAGGTGATCTACCCACCT TGGCCTCCCAAATTGCTGGGATTACAGGCGTGAACCACTGCTCCCTTCCCTGTCCTTCTGAT TTTGTAGGTAACCACGTGCGGACCGAGCGGCCGC (SEQ ID NO: 331) |
| 3050 (3035) GCGGCCGCACGCGTATTTTTACTTGATTGTTTTGCCTACTGAATCCAACCAGTAAAAGTAAAT ATTCTCCCTTTTCCCCGCTGGAGAGAGGCAGATAGAACCAGTTCTAGTCTGGGAACTACTTC CTGGTTGCACAGGAGCCTGCTAGAGCCTCCTCCCCCGACTCAGCTGGGCACAGGAAGGTGG CTTCGTCCCTAAAAGGTAGCGCCCGAGGTCTGGTGAGGACACAGTGAGCTGGTTGGCCATG TGAAGTGAGCCAGAGGAGGAGAAGGTTGAGGTCGCTGGTCCTTAGCTCTGACCTGCTGTTC CCGGTTTCCTTCAGCCAATTCTCCCTTCGATTATTTTTAGCATGGAGCAGCGGACAAAGGCAG TGGGCCAGCAAGGGAAGATAGATTTCTATCTTAACCAGGCCACTTACACGGGACCTCTGTCT TCTAGTCTGTAGAGTATAGTAGATAGTCCCAGCGCTTTACCCTGTCACTGTTAAAAACACTAT GACCTGCACAGAGCTCGGGCTGGGCATAAAGTCAGGGCAGAGCCATCTATTGCTTACATTT GCTTCTGGCGTGGCCACCATGGCTCCTAAGAAGAAGAGGAAGGTGATGAGCCAGTTCGACA TCCTGTGCAAGACCCCCCCCAAGGTGCTGGTGCGGCAGTTCGTGGAGAGATTCGAGAGGCC CAGCGGCGAGAAGATCGCCAGCTGTGCCGCCGAGCTGACCTACCTGTGCTGGATGATCACC |

| Fig 26 cont'd |
| :--- |
| Vector ID (length between ITRs) & Sequence Between ITRs |
| CACAACGGCACCGCCATCAAGAGGGCCCACCTTCATGAGCTACAACACCATCATCAGCAACAG CCTGAGCTTCGACATCGTGAACAAGAGCCTGCAGTTCAAGTACAAGACCCAGAAGGCCACCA TCCTGGAGGCCAGCCTGAAGAAGCTGATCCCCGCCTGGGAGTTCACCATCATCCCTTACAAC GGCCAGAAGCACCAGAGCGACATCACCGACATCGTGTCCAGCCTGCAGCTGCAGTTCGAGA GCAGCGAGGAGGCCGACAAGGGCAACAGCCACAGCAAGAAGATGCTGAAGGCCCTGCTGT CCGAGGGCGAGAGCATCTGGGAGATCACCGAGAAGATCCTGAACAGCTTCGAGTACACCAG CAGGTTCACCAAGACCAAGACCCTGTACCAGTTCCTGTTCCTGGCCACATTCATCAACTGCG GCAGGTTCAGCGACATCAAGAACGTGGACCCCAAGAGCTTCAAGCTGGTGCAGAACAAGTA CCTGGGCGTGATCATTCAGTGCCTGGTGACCGAGACCAAGACAAGCGTGTCCAGGCACATC TACTTTTTCAGCGCCAGAGGCAGGATCGACCCCCTGGTGTACCTGGACGAGTTCCTGAGGAA CAGCGAGCCCGTGCTGAAGAGAGTGAACAGGACCGGCAACAGCAGCAGCAACAAGCAGGA GTACCAGCTGCTGAAGGACAACCTGGTGCGCAGCTACAACAAGGCCCTGAAGAAGAACGCC CCCTACCCCATCTTCGCTATCAAGAACGGCCCTAAGAGCCACATCGGCAGGCACCTGATGAC CAGCTTTCTGAGCATGAAGGGCCTGACCGAGCTGACAAACGTGGTGGGCAACTGGAGCGAC AAGAGGGCCTCCGCCGTGGCCAGGACCACCTACACCCACCAGATCACCGCCATCCCCGACC ACTACTTCGCCCTGGTGTCCAGGTACTACGCCTACGACCCCATCAGCAAGGAGATGATCGCC CTGAAGGACGAGACCAACCCCATCGAGGAGTGGCAGCACATCGAGCAGCTGAAGGGCAGC GCCGAGGGCAGCATCAGATACCCCGCCTGGAACGGCATCATCAGCCAGGAGGTGCTGGACT ACCTGAGCAGCTACATCAACAGGCGGATCTGAGAATTCGATATCAAGCTTATCGATAATCAAC CTCTGGATTACAAAATTTGTGAAAGATTGACTGGTATTCTTAACTATGTTGCTCCTTTTACGCT ATGTGGATACGCTGCTTTAATGCCTTTGTATCATGCTATTGCTTCCCGTATGGCTTTCATTTTC TCCTCCTTGTATAAATCCTGGTTGCTGTCTCTTTATGAGGAGTTGTGGCCCGTTGTCAGGCAA CGTGGCGTGGTGTGCACTGTGTTTGCTGACGCAACCCCCACTGGTTGGGGCATTGCCACCA CCTGTCAGCTCCTTTCCGGGACTTTCGCTTTCCCCCTCCCTATTGCCACGGCGGAACTCATC GCCGCCTGCCTTGCCCGCTGCTGGACAGGGGCTCGGCTGTTGGGCACTGACAATTCCGTGG TGTTGTCGGGGAAATCATCGTCCTTTCCTTGGCTGCTCGCCTATGTTGCCACCTGGATTCTG CGCGGGACGTCCTTCTGCTACGTCCCTTCGGCCCTCAATCCAGCGGACCTTCCTTCCCGCG GCCTGCTGCCGGCTCTGCGGCCTCTTCCGCGTCTTCGCCTTCGCCCTCAGACGAGTCGGAT CTCCCTTTGGGCCGCCTCCCCGCATCGATACCGAGCGCTGCTCGAGAGATCTACGGGTGGC ATCCCTGTGACCCCTCCCCAGTGCCTCTCCTGGCCCTGGAAGTTGCCACTCCAGTGCCCAC CAGCCTTGTCCTAATAAAATTAAGTTGCATCATTTTGTCTGACTAGGTGTCCTTCTATAATATT ATGGGGTGGAGGGGGGTGGTATGGAGCAAGGGGCAAGTTGGGAAGACAACCTGTAGGGCC TGCGGGGTCTATTGGGAACCAAGCTGGAGTGCAGTGGCACAATCTTGGCTCACTGCAATCTC CGCCTCCTGGGTTCAAGCGATTCTCCTGCCTCAGCCTCCCGAGTTGTTGGGATTCCAGGCAT GCATGACCAGGCTCAGCTAATTTTTGTTTTTTTGGTAGAGACGGGGTTTCACCATATTGGCCA GGCTGGTCTCCAACTCCTAATCTCAGGTGATCTACCCACCTTGGCCTCCCAAATTGCTGGGA TTACAGGCGTGAACCACTGCTCCCTTCCCTGTCCTTCTGATTTTGTAGGTAACCACGTGCGG ACCGAGCGGCCGC (SEQ ID NO: 332) |
| 3051 (2921) GCGGCCGCACGCGTCAATGTAAATAGACAGTGACTATCCCATCCTGTAGGATGGTGGGAACT GGCCAAGTCTTTTTTCTTCCCCTTCTTTCCCAGTGTTTAGGGTCCTTCAGAGAGAGACACTCA GCTGCCCAGATCTCCCAGGAGCCTGCTACTGGCTCTGTCCAAATAAGCTCAGTAAACAGCCC CAGGGTGCTCTCTCTAGCTCGCTTGCGCTCTCTCTCTCTCTCTCTCTCTCTCTCTCTCTCTCT CTCTCCCCCTCTCTCCCTGTATCCCTCTCCCCCTCCCTCCCTCCCTTGTCAGAGTGTGTTGCA GCTTTTCAAATGCTTAGACAAACATTTCCTGTCCTCAGGGGAGTGATCTGAGCTCTCCTGAGG TCCTGACCATTGCCCAGAGCTCGGGCTGGGCATAAAAGTCAGGGCAGAGCCATCTATTGCTT ACATTTGCTTCTGGCGTGGCCACCATGGCTCCTAAGAAGAAGAGGAAGGTGATGAGCCAGTT CGACATCCTGTGCAAGACCCCCCCCAAGGTGCTGGTGCGGCAGTTCGTGGAGAGATTCGAG AGGCCCAGCGGCGAGAAGATCGCCAGCTGTGCCGCCGAGCTGACCTACCTGTGCTGGATG |

| Fig 26 cont'd |
|---|
| Vector ID (length between ITRs) & Sequence Between ITRs |
| ATCACCCACAACGGCACCGCCATCAAGAGGGCCACCTTCATGAGCTACAACACCATCATCAG<br>CAACAGCCTGAGCTTCGACATCGTGAACAAGAGCCTGCAGTTCAAGTACAAGACCCAGAAGG<br>CCACCATCCTGGAGGCCAGCCTGAAGAAGCTGATCCCCGCCTGGGAGTTCACCATCATCCC<br>TTACAACGGCCAGAAGCACCAGAGCGACATCACCGACATCGTGTCCAGCCTGCAGCTGCAG<br>TTCGAGAGCAGCGAGGAGGCCGACAAGGGCAACAGCCACAGCAAGAAGATGCTGAAGGCC<br>CTGCTGTCCGAGGGCGAGAGCATCTGGGAGATCACCGAGAAGATCCTGAACAGCTTCGAGT<br>ACACCAGCAGGTTCACCAAGACCAAGACCCTGTACCAGTTCCTGTTCCTGGCCACATTCATC<br>AACTGCGGCAGGTTCAGCGACATCAAGAACGTGGACCCCAAGAGCTTCAAGCTGGTGCAGA<br>ACAAGTACCTGGGCGTGATCATTCAGTGCCTGGTGACCGAGACCAAGACAAGCGTGTCCAG<br>GCACATCTACTTTTTCAGCGCCAGAGGCAGGATCGACCCCCTGGTGTACCTGGACGAGTTCC<br>TGAGGAACAGCGAGCCCGTGCTGAAGAGAGTGAACAGGACCGGCAACAGCAGCAGCAACAA<br>GCAGGAGTACCAGCTGCTGAAGGACAACCTGGTGCGCAGCTACAACAAGGCCCTGAAGAAG<br>AACGCCCCCTACCCCATCTTCGCTATCAAGAACGGCCCTAAGAGCCACATCGGCAGGCACCT<br>GATGACCAGCTTTCTGAGCATGAAGGGCCTGACCGAGCTGACAAACGTGGTGGGCAACTGG<br>AGCGACAAGAGGGCCTCCGCCGTGGCCAGGACCACCTACACCCACCAGATCACCGCCATCC<br>CCGACCACTACTTCGCCCTGGTGTCCAGGTACTACGCCTACGACCCCATCAGCAAGGAGAT<br>GATCGCCCTGAAGGACGAGACCAACCCCATCGAGGAGTGGCAGCACATCGAGCAGCTGAAG<br>GGCAGCGCCGAGGGCAGCATCAGATACCCCGCCTGGAACGGCATCATCAGCCAGGAGGTG<br>CTGGACTACCTGAGCAGCTACATCAACAGGCGGATCTGAGAATTCGATATCAAGCTTATCGA<br>TAATCAACCTCTGGATTACAAAATTTGTGAAAGATTGACTGGTATTCTTAACTATGTTGCTCCT<br>TTTACGCTATGTGGATACGCTGCTTTAATGCCTTTGTATCATGCTATTGCTTCCCGTATGGCTT<br>TCATTTTCTCCTCCTTGTATAAATCCTGGTTGCTGTCTCTTTATGAGGAGTTGTGGCCCGTTGT<br>CAGGCAACGTGGCGTGGTGTGCACTGTGTTTGCTGACGCAACCCCCACTGGTTGGGGCATT<br>GCCACCACCTGTCAGCTCCTTTCCGGGACTTTCGCTTTCCCCCTCCCTATTGCCACGGCGGA<br>ACTCATCGCCGCCTGCCTTGCCCGCTGCTGGACAGGGGCTCGGCTGTTGGGCACTGACAAT<br>TCCGTGGTGTTGTCGGGGAAATCATCGTCCTTTCCTTGGCTGCTCGCCTATGTTGCCACCTG<br>GATTCTGCGCGGGACGTCCTTCTGCTACGTCCCTTCGGCCCTCAATCCAGCGGACCTTCCTT<br>CCCGCGGCCTGCTGCCGGCTCTGCGGCCTCTTCCGCGTCTTCGCCTTCGCCCTCAGACGAG<br>TCGGATCTCCCTTTGGGCCGCCTCCCCGCATCGATACCGAGCGCTGCTCGAGAGATCTACG<br>GGTGGCATCCCTGTGACCCCTCCCCAGTGCCTCTCCTGGCCCTGGAAGTTGCCACTCCAGT<br>GCCCACCAGCCTTGTCCTAATAAAATTAAGTTGCATCATTTTGTCTGACTAGGTGTCCTTCTAT<br>AATATTATGGGGTGGAGGGGGGTGGTATGGAGCAAGGGGCAAGTTGGGAAGACAACCTGTA<br>GGGCCTGCGGGGTCTATTGGGAACCAAGCTGGAGTGCAGTGGCACAATCTTGGCTCACTGC<br>AATCTCCGCCTCCTGGGTTCAAGCGATTCTCCTGCCTCAGCCTCCCGAGTTGTTGGGATTCC<br>AGGCATGCATGACCAGGCTCAGCTAATTTTTGTTTTTTTGGTAGAGACGGGGTTTCACCATAT<br>TGGCCAGGCTGGTCTCCAACTCCTAATCTCAGGTGATCTACCCACCTTGGCCTCCCAAATTG<br>CTGGGATTACAGGCGTGAACCACTGCTCCCTTCCCTGTCCTTCTGATTTTGTAGGTAACCAC<br>GTGCGGACCGAGCGGCCGC (SEQ ID NO: 333) |
| 3052 (2920)<br>GCGGCCGCACGCGTGAGAAGAATGGCAAGTGTGTGAGAGAGGGCAAAGCAGAAAAGGGCC<br>AAGCGGGTCCTCAGGGAGAAGCCACAGCCCTCTCCAGCCTGTGCTGTCCAGGAACAAAGCT<br>GCCCTAGGCCTCCCCAGGGGCTCACTGGCCGGTCTCTGGGTTTCCCCGGCTAAGAGCTCCC<br>GGCACAGGGGAGGAGCCGGGAGTGGGCGGGGTCGTGAACACGGGCTGGGGCGGGGCTAG<br>AGGGGGAGGGCTCAGCCTTAGTCCCTTTGGGTGTCTAGAGGGCGGGGCCTAGGCTGATGG<br>AGATCCGTGACCCTAGAGGATACACTCTGAAGGAGGTCAGGGCCACGACAGAGAAGGGGAG<br>GAGGCAGGCGGCTGTGCAAATAAAGGTTTGAGCTCGGGCTGGGCATAAAAGTCAGGGCAGA<br>GCCATCTATTGCTTACATTTGCTTCTGGCGTGGCCACCATGGCTCCTAAGAAGAAGAGGAAG<br>GTGATGAGCCAGTTCGACATCCTGTGCAAGACCCCCCCCAAGGTGCTGGTGCGGCAGTTCG<br>TGGAGAGATTCGAGAGGCCCAGCGGCGAGAAGATCGCCAGCTGTGCCGCCGAGCTGACCT |

| Fig 26 cont'd |
| Vector ID (length between ITRs) & Sequence Between ITRs |

ACCTGTGCTGGATGATCACCCACAACGGCACCGCCATCAAGAGGGCCACCTTCATGAGCTA
CAACACCATCATCAGCAACAGCCTGAGCTTCGACATCGTGAACAAGAGCCTGCAGTTCAAGT
ACAAGACCCAGAAGGCCACCATCCTGGAGGCCAGCCTGAAGAAGCTGATCCCCGCCTGGGA
GTTCACCATCATCCCTTACAACGGCCAGAAGCACCAGAGCGACATCACCGACATCGTGTCCA
GCCTGCAGCTGCAGTTCGAGAGCAGCGAGGAGGCCGACAAGGGCAACAGCCACAGCAAGA
AGATGCTGAAGGCCCTGCTGTCCGAGGGCGAGAGCATCTGGGAGATCACCGAGAAGATCCT
GAACAGCTTCGAGTACACCAGCAGGTTCACCAAGACCAAGACCCTGTACCAGTTCCTGTTCC
TGGCCACATTCATCAACTGCGGCAGGTTCAGCGACATCAAGAACGTGGACCCCAAGAGCTTC
AAGCTGGTGCAGAACAAGTACCTGGGCGTGATCATTCAGTGCCTGGTGACCGAGACCAAGA
CAAGCGTGTCCAGGCACATCTACTTTTTCAGCGCCAGAGGCAGGATCGACCCCCTGGTGTAC
CTGGACGAGTTCCTGAGGAACAGCGAGCCCGTGCTGAAGAGAGTGAACAGGACCGGCAACA
GCAGCAGCAACAAGCAGGAGTACCAGCTGCTGAAGGACAACCTGGTGCGCAGCTACAACAA
GGCCCTGAAGAAGAACGCCCCCTACCCCATCTTCGCTATCAAGAACGGCCCTAAGAGCCAC
ATCGGCAGGCACCTGATGACCAGCTTTCTGAGCATGAAGGGCCTGACCGAGCTGACAAACG
TGGTGGGCAACTGGAGCGACAAGAGGGCCTCCGCCGTGGCCAGGACCACCTACACCCACC
AGATCACCGCCATCCCCGACCACTACTTCGCCCTGGTGTCCAGGTACTACGCCTACGACCCC
ATCAGCAAGGAGATGATCGCCCTGAAGGACGAGACCAACCCCATCGAGGAGTGGCAGCACA
TCGAGCAGCTGAAGGGCAGCGCCGAGGGCAGCATCAGATACCCCGCCTGGAACGGCATCA
TCAGCCAGGAGGTGCTGGACTACCTGAGCAGCTACATCAACAGGCGGATCTGAGAATTCGAT
ATCAAGCTTATCGATAATCAACCTCTGGATTACAAAATTTGTGAAAGATTGACTGGTATTCTTA
ACTATGTTGCTCCTTTTACGCTATGTGGATACGCTGCTTTAATGCCTTTGTATCATGCTATTGC
TTCCCGTATGGCTTTCATTTTCTCCTCCTTGTATAAATCCTGGTTGCTGTCTCTTTATGAGGAG
TTGTGGCCCGTTGTCAGGCAACGTGGCGTGGTGTGCACTGTGTTTGCTGACGCAACCCCCA
CTGGTTGGGGCATTGCCACCACCTGTCAGCTCCTTTCCGGGACTTTCGCTTTCCCCCTCCCT
ATTGCCACGGCGGAACTCATCGCCGCCTGCCTTGCCCGCTGCTGGACAGGGGCTCGGCTGT
TGGGCACTGACAATTCCGTGGTGTTGTCGGGGAAATCATCGTCCTTTCCTTGGCTGCTCGCC
TATGTTGCCACCTGGATTCTGCGCGGGACGTCCTTCTGCTACGTCCCTTCGGCCCTCAATCC
AGCGGACCTTCCTTCCCGCGGCCTGCTGCCGGCTCTGCGGCCTCTTCCGCGTCTTCGCCTT
CGCCCTCAGACGAGTCGGATCTCCCTTTGGGCCGCCTCCCCGCATCGATACCGAGCGCTGC
TCGAGAGATCTACGGGTGGCATCCCTGTGACCCCTCCCCAGTGCCTCTCCTGGCCCTGGAA
GTTGCCACTCCAGTGCCCACCAGCCTTGTCCTAATAAAATTAAGTTGCATCATTTTGTCTGAC
TAGGTGTCCTTCTATAATATTATGGGGTGGAGGGGGGTGGTATGGAGCAAGGGGCAAGTTG
GGAAGACAACCTGTAGGGCCTGCGGGGTCTATTGGGAACCAAGCTGGAGTGCAGTGGCACA
ATCTTGGCTCACTGCAATCTCCGCCTCCTGGGTTCAAGCGATTCTCCTGCCTCAGCCTCCCG
AGTTGTTGGGATTCCAGGCATGCATGACCAGGCTCAGCTAATTTTTGTTTTTTTGGTAGAGAC
GGGGTTTCACCATATTGGCCAGGCTGGTCTCCAACTCCTAATCTCAGGTGATCTACCCACCT
TGGCCTCCCAAATTGCTGGGATTACAGGCGTGAACCACTGCTCCCTTCCCTGTCCTTCTGAT
TTTGTAGGTAACCACGTGCGGACCGAGCGGCCGC (SEQ ID NO: 334)

CN2845 (1973)
GCGGCCGCACGCGTAAGCATGAATGGCCTCTCAGGATGGAAGGGGGGCGGGGAGAGAAGA
AAGCCGGTCAGAGGCAGCAGTTGCTTTTAAGAATATGTAAGATTTCTAGTTTCTGAGGTGCTG
TGTTATAGCAGCTTTAAGCAAGACCTAACAATTTGTTAAATACTTCATCTCCAAACAGTGGTGG
GTACTACAGTTTCATGAGCAGCAGATAATAGATTCTGTTTATTCGCCAACAATACCGACACTG
TTTCGCCCCGGACTGCAAGTGGCTGAGCCATCTGGCTCCTATCTCCACAGTAAAACATTGTC
CGTGACACAAAAAATGACTACATCCCCAGGACAAACTAGTGTGACCTCTAAATAAAGCCTTCC
TCTGAAGCTATGATATCACACTGCACAGGGGACACCAGCACAATTGAATCTGGTCACCAAAA
GCCCAAGTGAGATAGGACTATGTAAATGGGATTTTATAGGAGACGTTTTGTCCTCTGTGCAAA
CCATCGAGATCCGTCCACAGCACTGAAACATCTTTTTCATTCACCCTGAGGACAACAGTGTGC
TTCTTTCTGGGGGGGTTGGCAGTCCTCTTTCTCCGGCCCCAGGCCGAGGAAGCACACATCCG

| Fig 26 cont'd |
|---|
| Vector ID (length between ITRs) & Sequence Between ITRs |

TGTCCCAGAGGTGGAGCTCGGGCTGGGCATAAAAGTCAGGGCAGAGCCATCTATTGCTTAC
ATTTGCTTCTGGGATCCAGATCTTTCGAAGCTAGCGCTACCGGTCGCCACCATGGTGAGCAA
GGGCGAGGAGCTGTTCACCGGGGTGGTGCCCATCCTGGTCGAGCTGGACGGCGACGTAAA
CGGCCACAAGTTCAGCGTGTCCGGCGAGGGCGAGGGCGATGCCACCTACGGCAAGCTGAC
CCTGAAGCTGATCTGCACCACCGGCAAGCTGCCCGTGCCCTGGCCCACCCTCGTGACCACC
CTGGGCTACGGCGTGCAGTGCTTCGCCCGCTACCCCGACCACATGAAGCAGCACGACTTCT
TCAAGTCCGCCATGCCCGAAGGCTACGTCCAGGAGCGCACCATCTTCTTCAAGGACGACGG
CAACTACAAGACCCGCGCCGAGGTGAAGTTCGAGGGCGACACCCTGGTGAACCGCATCGAG
CTGAAGGGCATCGACTTCAAGGAGGACGGCAACATCCTGGGGCACAAGCTGGAGTACAACT
ACAACAGCCACAACGTCTATATCACCGCCGACAAGCAGAAGAACGGCATCAAGGCCAACTTC
AAGATCCGCCACAACATCGAGGACGGCGGCGTGCAGCTCGCCGACCACTACCAGCAGAACA
CCCCCATCGGCGACGGCCCCGTGCTGCTGCCCGACAACCACTACCTGAGCTACCAGTCCAA
GCTGAGCAAAGACCCCAACGAGAAGCGCGATCACATGGTCCTGCTGGAGTTCGTGACCGCC
GCCGGGATCACTCTCGGCATGGACGAGCTGTACAAGTAAGTCGACGGCGCGCCGCGGCCG
CGAATTCGATATCATAATCAACCTCTGGATTACAAAATTTGTGAAAGATTGACTGGTATTCTTA
ACTATGTTGCTCCTTTTACGCTATGTGGATACGCTGCTTTAATGCCTTTGTATCATGCTATTGC
TTCCCGTATGGCTTTCATTTTCTCCTCCTTGTATAAATCCTGGTTAGTTCTTGCCACGGCGGA
ACTCATCGCCGCCTGCCTTGCCCGCTGCTGGACAGGGGCTCGGCTGTTGGGCACTGACAAT
TCCGTGGCTCGAGAGATCTTCGACTGTGCCTTCTAGTTGCCAGCCATCTGTTGTTTGCCCCT
CCCCCGTGCCTTCCTTGACCCTGGAAGGTGCCACTCCCACTGTCCTTTCCTAATAAAATGAG
GAAATTGCATCGCATTGTCTGAGTAGGTGTCATTCTATTCTGGGGGGTGGGGTGGGGCAGG
ACAGCAAGGGGGAGGATTGGGAAGACAATAGCAGGCATGAGATCTCACGTGCGGACCGA
(SEQ ID NO: 373)

CN2556 (1961)
GCGGCCGCACGCGTACACTCTTCCCTTTATTCTTTCTTCCAGGCCTTTTAGTGTTTGCTTAAT
CAGAATATTTTAATCTCTAATGTGGTGACTAGATGTAATTTATCACATTAAGCCTCTCCTATTTT
CTTCTGCTTACATGACTAACGTTATTGTGTTTTTATTGCGCTTATACAAACAAGCCTTTCCTTT
GTTCCATTGTTTCAGCAATAGGTCAACACTCTTCCCTTTATTCTTTCTTCCAGGCCTTTTAGTG
TTTGCTTAATCAGAATATTTTAATCTCTAATGTGGTGACTAGATGTAATTTATCACATTAAGCCT
CTCCTATTTTCTTCTGCTTACATGACTAACGTTATTGTGTTTTTATTGCGCTTATACAAACAAGC
CTTTCCTTTGTTCCATTGTTTCAGCAATAGGTCAACACTCTTCCCTTTATTCTTTCTTCCAGGC
CTTTTAGTGTTTGCTTAATCAGAATATTTTAATCTCTAATGTGGTGACTAGATGTAATTTATCAC
ATTAAGCCTCTCCTATTTTCTTCTGCTTACATGACTAACGTTATTGTGTTTTTATTGCGCTTATA
CAAACAAGCCTTTCCTTTGTTCCATTGTTTCAGCAATAGGTCAGAGCTCGGGCTGGGCATAAA
AGTCAGGGCAGAGCCATCTATTGCTTACATTTGCTTCTGGGATCCAGATCTTTCGAAGCTAGC
GCTACCGGTCGCCACCATGGTGAGCAAGGGCGAGGAGCTGTTCACCGGGGTGGTGCCCAT
CCTGGTCGAGCTGGACGGCGACGTAAACGGCCACAAGTTCAGCGTGTCCGGCGAGGGCGA
GGGCGATGCCACCTACGGCAAGCTGACCCTGAAGCTGATCTGCACCACCGGCAAGCTGCCC
GTGCCCTGGCCCACCCTCGTGACCACCCTGGGCTACGGCGTGCAGTGCTTCGCCCGCTACC
CCGACCACATGAAGCAGCACGACTTCTTCAAGTCCGCCATGCCCGAAGGCTACGTCCAGGA
GCGCACCATCTTCTTCAAGGACGACGGCAACTACAAGACCCGCGCCGAGGTGAAGTTCGAG
GGCGACACCCTGGTGAACCGCATCGAGCTGAAGGGCATCGACTTCAAGGAGGACGGCAACA
TCCTGGGGCACAAGCTGGAGTACAACTACAACAGCCACAACGTCTATATCACCGCCGACAAG
CAGAAGAACGGCATCAAGGCCAACTTCAAGATCCGCCACAACATCGAGGACGGCGGCGTGC
AGCTCGCCGACCACTACCAGCAGAACACCCCCATCGGCGACGGCCCCGTGCTGCTGCCCG
ACAACCACTACCTGAGCTACCAGTCCAAGCTGAGCAAAGACCCCAACGAGAAGCGCGATCA
CATGGTCCTGCTGGAGTTCGTGACCGCCGCCGGGATCACTCTCGGCATGGACGAGCTGTAC
AAGTAAGTCGACGGCGCGCCGCGGCCGCGAATTCGATATCATAATCAACCTCTGGATTACAA
AATTTGTGAAAGATTGACTGGTATTCTTAACTATGTTGCTCCTTTTACGCTATGTGGATACGCT

| Fig 26 cont'd |
| --- |
| Vector ID (length between ITRs) & Sequence Between ITRs |
| GCTTTAATGCCTTTGTATCATGCTATTGCTTCCCGTATGGCTTTCATTTTCTCCTCCTTGTATA AATCCTGGTTAGTTCTTGCCACGGCGGAACTCATCGCCGCCTGCCTTGCCCGCTGCTGGACA GGGGCTCGGCTGTTGGGCACTGACAATTCCGTGGCTCGAGAGATCTTCGACTGTGCCTTCTA GTTGCCAGCCATCTGTTGTTTGCCCCTCCCCCGTGCCTTCCTTGACCCTGGAAGGTGCCACT CCCACTGTCCTTTCCTAATAAAATGAGGAAATTGCATCGCATTGTCTGAGTAGGTGTCATTCT ATTCTGGGGGGTGGGGTGGGGCAGGACAGCAAGGGGGAGGATTGGGAAGACAATAGCAGG CATGCACGTGCGGACCGAGCGGCCGC  (SEQ ID NO: 374) |
| CN2558 (2102) <br> GCGGCCGCACGCGTGAAAGGAAAGAGCTTGCTTTCAACCTCAAAAGCTAGGAGGAAAGGGC TCTGAAATTTGCTCAGAATTCCCAATTCACCATTAGCCTGTTTCTTCCTTTAGCCTCAAGGCAT TCTCCGCTTTTTGAAAAGATGTTAAGAAATTCAGTCACAATAGAGAGCCTAGTTTTGAACATGT TTCACTCGGTCCATTGAGGTCTGGGCTCCAGCCTTTGTGTGGGGTGAATTGAGCTGAGCGG CTAGCTGGTTGGAGGAAAGGAAAGAGCTTGCTTTCAACCTCAAAAGCTAGGAGGAAAGGGCT CTGAAATTTGCTCAGAATTCCCAATTCACCATTAGCCTGTTTCTTCCTTTAGCCTCAAGGCATT CTCCGCTTTTTGAAAAGATGTTAAGAAATTCAGTCACAATAGAGAGCCTAGTTTTGAACATGTT TCACTCGGTCCATTGAGGTCTGGGCTCCAGCCTTTGTGTGGGGTGAATTGAGCTGAGCGGC TAGCTGGTTGGAGGAAAGGAAAGAGCTTGCTTTCAACCTCAAAAGCTAGGAGGAAAGGGCTC TGAAATTTGCTCAGAATTCCCAATTCACCATTAGCCTGTTTCTTCCTTTAGCCTCAAGGCATTC TCCGCTTTTTGAAAAGATGTTAAGAAATTCAGTCACAATAGAGAGCCTAGTTTTGAACATGTTT CACTCGGTCCATTGAGGTCTGGGCTCCAGCCTTTGTGTGGGGTGAATTGAGCTGAGCGGCT AGCTGGTTGGAGGAGCTCGGGCTGGGCATAAAAGTCAGGGCAGAGCCATCTATTGCTTACA TTTGCTTCTGGGATCCAGATCTTTCGAAGCTAGCGCTACCGGTCGCCACCATGGTGAGCAAG GGCGAGGAGCTGTTCACCGGGGTGGTGCCCATCCTGGTCGAGCTGGACGGCGACGTAAAC GGCCACAAGTTCAGCGTGTCCGGCGAGGGCGAGGGCGATGCCACCTACGGCAAGCTGACC CTGAAGCTGATCTGCACCACCGGCAAGCTGCCCGTGCCCTGGCCCACCCTCGTGACCACCC TGGGCTACGGCGTGCAGTGCTTCGCCCGCTACCCCGACCACATGAAGCAGCACGACTTCTT CAAGTCCGCCATGCCCGAAGGCTACGTCCAGGAGCGCACCATCTTCTTCAAGGACGACGGC AACTACAAGACCCGCGCCGAGGTGAAGTTCGAGGGCGACACCCTGGTGAACCGCATCGAGC TGAAGGGCATCGACTTCAAGGAGGACGGCAACATCCTGGGGCACAAGCTGGAGTACAACTA CAACAGCCACAACGTCTATATCACCGCCGACAAGCAGAAGAACGGCATCAAGGCCAACTTCA AGATCCGCCACAACATCGAGGACGGCGGCGTGCAGCTCGCCGACCACTACCAGCAGAACAC CCCCATCGGCGACGGCCCCGTGCTGCTGCCCGACAACCACTACCTGAGCTACCAGTCCAAG CTGAGCAAAGACCCCAACGAGAAGCGCGATCACATGGTCCTGCTGGAGTTCGTGACCGCCG CCGGGATCACTCTCGGCATGGACGAGCTGTACAAGTAAGTCGACGGCGCGCCGCGGCCGC GAATTCGATATCATAATCAACCTCTGGATTACAAAATTTGTGAAAGATTGACTGGTATTCTTAA CTATGTTGCTCCTTTTACGCTATGTGGATACGCTGCTTTAATGCCTTTGTATCATGCTATTGCT TCCCGTATGGCTTTCATTTTCTCCTCCTTGTATAAATCCTGGTTAGTTCTTGCCACGGCGGAA CTCATCGCCGCCTGCCTTGCCCGCTGCTGGACAGGGGCTCGGCTGTTGGGCACTGACAATT CCGTGGCTCGAGAGATCTTCGACTGTGCCTTCTAGTTGCCAGCCATCTGTTGTTTGCCCCTC CCCCGTGCCTTCCTTGACCCTGGAAGGTGCCACTCCCACTGTCCTTTCCTAATAAAATGAGG AAATTGCATCGCATTGTCTGAGTAGGTGTCATTCTATTCTGGGGGGTGGGGTGGGGCAGGAC AGCAAGGGGGAGGATTGGGAAGACAATAGCAGGCATGCACGTGCGGACCGAGCGGCCGC (SEQ ID NO: 375) |
| CN2560 (2309) <br> GCGGCCGCACGCGTATGTTTGGGGTAAGGGATGGAAGTGGAAAAAAAAAAAAAAAAAAGGAA AGAAAAAGCAAACAAAAGCCAACCAGCCTTCCAGCTGCTGAAGGAGCTGGGGCACAACCCTT GAAGAGTGCCCCTGCCGGGAACAGAGAGGACTCCAGCTGCCTGCCCACTGGGCCAGAGCG CTGCCTTAAAAGAACTTTTGCATAAAAGGAAAAGAGGCCAAGGCTCCCCTTTTGCTGCAGGA CACAGGGCCAGTGTCCACAAGAGTTGAGTGTCCTGGCCAAAGCCAAAGCTAGGGATCATTG |

| Fig 26 cont'd |
| :--- |
| Vector ID (length between ITRs) & Sequence Between ITRs |
| AAAATGCCTGGGCAGCTGGCATGGCTGATGTTTGGGGTAAGGGATGGAAGTGGAAAAAAAA |
| AAAAAAAAAGGAAAGAAAAAGCAAACAAAAGCCAACCAGCCTTCCAGCTGCTGAAGGAGCTG |
| GGGCACAACCCTTGAAGAGTGCCCCTGCCGGGAACAGAGAGGACTCCAGCTGCCTGCCCAC |
| TGGGCCAGAGCGCTGCCTTAAAAGAACTTTTGCATAAAAGGAAAAGAGGCCAAGGCTCCCCT |
| TTTGCTGCAGGACACAGGGCCAGTGTCCACAAGAGTTGAGTGTCCTGGCCAAAGCCAAAGC |
| TAGGGATCATTGAAAATGCCTGGGCAGCTGGCATGGCTGATGTTTGGGGTAAGGGATGGAA |
| GTGGAAAAAAAAAAAAAAAAAAGGAAAGAAAAAGCAAACAAAAGCCAACCAGCCTTCCAGCTG |
| CTGAAGGAGCTGGGGCACAACCCTTGAAGAGTGCCCCTGCCGGGAACAGAGAGGACTCCA |
| GCTGCCTGCCCACTGGGCCAGAGCGCTGCCTTAAAAGAACTTTTGCATAAAAGGAAAAGAGG |
| CCAAGGCTCCCCTTTTGCTGCAGGACACAGGGCCAGTGTCCACAAGAGTTGAGTGTCCTGG |
| CCAAAGCCAAAGCTAGGGATCATTGAAAATGCCTGGGCAGCTGGCATGGCTGGAGCTCGGG |
| CTGGGCATAAAAGTCAGGGCAGAGCCATCTATTGCTTACATTTGCTTCTGGGATCCAGATCTT |
| TCGAAGCTAGCGCTACCGGTCGCCACCATGGTGAGCAAGGGCGAGGAGCTGTTCACCGGG |
| GTGGTGCCCATCCTGGTCGAGCTGGACGGCGACGTAAACGGCCACAAGTTCAGCGTGTCCG |
| GCGAGGGCGAGGGCGATGCCACCTACGGCAAGCTGACCCTGAAGCTGATCTGCACCACCG |
| GCAAGCTGCCCGTGCCCTGGCCCACCCTCGTGACCACCCTGGGCTACGGCGTGCAGTGCTT |
| CGCCCGCTACCCCGACCACATGAAGCAGCACGACTTCTTCAAGTCCGCCATGCCCGAAGGC |
| TACGTCCAGGAGCGCACCATCTTCTTCAAGGACGACGGCAACTACAAGACCCGCGCCGAGG |
| TGAAGTTCGAGGGCGACACCCTGGTGAACCGCATCGAGCTGAAGGGCATCGACTTCAAGGA |
| GGACGGCAACATCCTGGGGCACAAGCTGGAGTACAACTACAACAGCCACAACGTCTATATCA |
| CCGCCGACAAGCAGAAGAACGGCATCAAGGCCAACTTCAAGATCCGCCACAACATCGAGGA |
| CGGCGGCGTGCAGCTCGCCGACCACTACCAGCAGAACACCCCCATCGGCGACGGCCCCGT |
| GCTGCTGCCCGACAACCACTACCTGAGCTACCAGTCCAAGCTGAGCAAAGACCCCAACGAG |
| AAGCGCGATCACATGGTCCTGCTGGAGTTCGTGACCGCCGCCGGGATCACTCTCGGCATGG |
| ACGAGCTGTACAAGTAAGTCGACGGCGCGCCGCGGCCGCGAATTCGATATCATAATCAACCT |
| CTGGATTACAAAATTTGTGAAAGATTGACTGGTATTCTTAACTATGTTGCTCCTTTTACGCTAT |
| GTGGATACGCTGCTTTAATGCCTTTGTATCATGCTATTGCTTCCCGTATGGCTTTCATTTTCTC |
| CTCCTTGTATAAATCCTGGTTAGTTCTTGCCACGGCGGAACTCATCGCCGCCTGCCTTGCCC |
| GCTGCTGGACAGGGGCTCGGCTGTTGGGCACTGACAATTCCGTGGCTCGAGAGATCTTCGA |
| CTGTGCCTTCTAGTTGCCAGCCATCTGTTGTTTGCCCCTCCCCCGTGCCTTCCTTGACCCTG |
| GAAGGTGCCACTCCCACTGTCCTTTCCTAATAAAATGAGGAAATTGCATCGCATTGTCTGAGT |
| AGGTGTCATTCTATTCTGGGGGGTGGGGTGGGGCAGGACAGCAAGGGGGAGGATTGGGAA |
| GACAATAGCAGGCATGCACGTGCGGACCGAGCGGCCGC (SEQ ID NO: 376) |

FIG. 27

Beta-Globin Minimal Promoter (pBGmin/minBGlobin/minBGprom):
GGGCTGGGCATAAAAGTCAGGGCAGAGCCATCTATTGCTTACATTTGCTTCTG (SEQ ID
NO: 335)

minCMV Promoter:
GAGGTAGGCGTGTACGGTGGGAGGCCTATATAAGCAGAGCTCGTTTAGTGAACCGTCAGA
TCGCCTGG (SEQ ID NO: 336)

Mutated minCMV Promoter (SacI RE site removed):
GAGGTAGGCGTGTACGGTGGGAGGCCTATATAAGCAGAGCTGGTTTAGTGAACCGTCAGA
TCGCCTGG (SEQ ID NO: 337)

minRho Promoter:
GATTCAGCCGGGAGCTTAGGGAGGGGAGGTCACTTCATAAGGGCCTGGGGGGGGAGTTG
GAGCCACGAGTCGTCCAGCCGGAGCCCCGTGTGGCTGAGCTCCGGCCTCAGAAGCATCC
CC (SEQ ID NO: 338)

**Mutated minRho\* Promoter (SacI RE site removed):**
GATTCAGCCGGGAGCTTAGGGAGGGGAGGTCACTTCATAAGGGCTTGGGGGGGGAGTTG
GAGCCACGAGTCGTCCAGCCGGAGCCCCGTGTGGCTGTGCTCCGGCCTCAGAAGCATCC
CC (SEQ ID NO: 339)

Hsp68 minimal Promoter (proHsp68):
CAGGAACATCCAAACTGAGCAGCCGGGGTCCCCCCCACCCCCCACCCCGCCCCACGCGG
CAACTTTGAGCCTGTGCTGGGACAGAGCCTCTAGTTCCTAAATTAGTCCATGAGGTCAGAG
GCAGCACTGCCATTGTAACGCGATTGGAGAGGATCACGTCACCGGACACGCCCCCAGGC
ATCTCCCTGGGTCTCCTAAACTTGGCGGGGAGAAGTTTTAGCCCTTAAGTTTTAGCCTTTAA
CCCCCATATTCAGAACTGTGCGAGTTGGCGAAACCCCACAAATCACAACAAACTGTACACA
ACACCGAGCTAGAGGTGATCTTTCTTGTCCATTCCACACAGGCCTTAGTAATGCGTCGCCA
TAGCAACAGTGTCACTAGTAGCACCAGCACTTCCCCACACCCTCCCCCTCAGGAATCCGTA
CTCTCCAGTGAACCCCAGAAACCTCTGGAGAGTTCTGGACAAGGGCGGAACCCACAACTC
CGATTACTCAAGGGAGGCGGGGAAGCTCCACCAGACGCGAAACTGCTGGAAGATTCCTG
GCCCCAAGGCCTCCTCCGGCTCGCTGATTGGCCCAGCGGAGAGTGGGCGGGGCCGGTG
AAGACTCCTTAAAGGCGCAGGGCGGCGAGCAGGTCACCAGACGCTGACAGCTACTCAGA
ACCAAATCTGGTTCCATCCAGAGACAAGCGAAGACAAGAGAAGCAGAGCGAGCGGCGCGT
TCCCGATCCTCGGCCAGGACCAGCCTTCCCCAGAGCATCCCTGCCGCGGAGCGCAACCT
TCCCAGGAGCATCCCTGCCGCGGAGCGCAACTTTCCCCGGAGCATCCACGCCGCGGAGC
GCAGCCTTCCAGAAGCAGAGCGCGGCGCC (SEQ ID NO: 340)

SYFP2:
ATGGTGAGCAAGGGCGAGGAGCTGTTCACCGGGGTGGTGCCCATCCTGGTCGAGCTGGA
CGGCGACGTAAACGGCCACAAGTTCAGCGTGTCCGGCGAGGGCGAGGGCGATGCCACCT
ACGGCAAGCTGACCCTGAAGCTGATCTGCACCACCGGCAAGCTGCCCGTGCCCTGGCCC
ACCCTCGTGACCACCCTGGGCTACGGCGTGCAGTGCTTCGCCCGCTACCCCGACCACAT
GAAGCAGCACGACTTCTTCAAGTCCGCCATGCCCGAAGGCTACGTCCAGGAGCGCACCAT
CTTCTTCAAGGACGACGGCAACTACAAGACCCGCGCCGAGGTGAAGTTCGAGGGCGACA
CCCTGGTGAACCGCATCGAGCTGAAGGGCATCGACTTCAAGGAGGACGGCAACATCCTG
GGGCACAAGCTGGAGTACAACTACAACAGCCACAACGTCTATATCACCGCCGACAAGCAG
AAGAACGGCATCAAGGCCAACTTCAAGATCCGCCACAACATCGAGGACGGCGGCGTGCA

FIG. 27 cont'd

GCTCGCCGACCACTACCAGCAGAACACCCCCATCGGCGACGGCCCCGTGCTGCTGCCCG
ACAACCACTACCTGAGCTACCAGTCCAAGCTGAGCAAAGACCCCAACGAGAAGCGCGATC
ACATGGTCCTGCTGGAGTTCGTGACCGCCGCCGGGATCACTCTCGGCATGGACGAGCTGT
ACAAGTAA (SEQ ID NO: 341)

EGFP:
ATGGTGAGCAAGGGCGAGGAGCTGTTCACCGGGGTGGTGCCCATCCTGGTCGAGCTGGA
CGGCGACGTAAACGGCCACAAGTTCAGCGTGTCCGGCGAGGGCGAGGGCGATGCCACCT
ACGGCAAGCTGACCCTGAAGTTCATCTGCACCACCGGCAAGCTGCCCGTGCCCTGGCCCA
CCCTCGTGACCACCCTGACCTACGGCGTGCAGTGCTTCAGCCGCTACCCCGACCACATGA
AGCAGCACGACTTCTTCAAGTCCGCCATGCCCGAAGGCTACGTCCAGGAGCGCACCATCT
TCTTCAAGGACGACGGCAACTACAAGACCCGCGCCGAGGTGAAGTTCGAGGGCGACACC
CTGGTGAACCGCATCGAGCTGAAGGGCATCGACTTCAAGGAGGACGGCAACATCCTGGG
GCACAAGCTGGAGTACAACTACAACAGCCACAACGTCTATATCATGGCCGACAAGCAGAA
GAACGGCATCAAGGTGAACTTCAAGATCCGCCACAACATCGAGGACGGCAGCGTGCAGCT
CGCCGACCACTACCAGCAGAACACCCCCATCGGCGACGGCCCCGTGCTGCTGCCCGACA
ACCACTACCTGAGCACCCAGTCCGCCCTGAGCAAAGACCCCAACGAGAAGCGCGATCACA
TGGTCCTGCTGGAGTTCGTGACCGCCGCCGGGATCACTCTCGGCATGGACGAGCTGTACA
AGTAA (SEQ ID NO: 342)

Optimized Flp recombinase (FlpO):
ATGGCTCCTAAGAAGAAGAGGAAGGTGATGAGCCAGTTCGACATCCTGTGCAAGACCCCC
CCCAAGGTGCTGGTGCGGCAGTTCGTGGAGAGATTCGAGAGGCCCAGCGGCGAGAAGAT
CGCCAGCTGTGCCGCCGAGCTGACCTACCTGTGCTGGATGATCACCCACAACGGCACCG
CCATCAAGAGGGCCACCTTCATGAGCTACAACACCATCATCAGCAACAGCCTGAGCTTCGA
CATCGTGAACAAGAGCCTGCAGTTCAAGTACAAGACCCAGAAGGCCACCATCCTGGAGGC
CAGCCTGAAGAAGCTGATCCCCGCCTGGGAGTTCACCATCATCCCTTACAACGGCCAGAA
GCACCAGAGCGACATCACCGACATCGTGTCCAGCCTGCAGCTGCAGTTCGAGAGCAGCG
AGGAGGCCGACAAGGGCAACAGCCACAGCAAGAAGATGCTGAAGGCCCTGCTGTCCGAG
GGCGAGAGCATCTGGGAGATCACCGAGAAGATCCTGAACAGCTTCGAGTACACCAGCAGG
TTCACCAAGACCAAGACCCTGTACCAGTTCCTGTTCCTGGCCACATTCATCAACTGCGGCA
GGTTCAGCGACATCAAGAACGTGGACCCCAAGAGCTTCAAGCTGGTGCAGAACAAGTACC
TGGGCGTGATCATTCAGTGCCTGGTGACCGAGACCAAGACAAGCGTGTCCAGGCACATCT
ACTTTTTCAGCGCCAGAGGCAGGATCGACCCCCTGGTGTACCTGGACGAGTTCCTGAGGA
ACAGCGAGCCCGTGCTGAAGAGAGTGAACAGGACCGGCAACAGCAGCAGCAACAAGCAG
GAGTACCAGCTGCTGAAGGACAACCTGGTGCGCAGCTACAACAAGGCCCTGAAGAAGAAC
GCCCCCTACCCCATCTTCGCTATCAAGAACGGCCCTAAGAGCCACATCGGCAGGCACCTG
ATGACCAGCTTTCTGAGCATGAAGGGCCTGACCGAGCTGACAAACGTGGTGGGCAACTGG
AGCGACAAGAGGGCCTCCGCCGTGGCCAGGACCACCTACACCCACCAGATCACCGCCAT
CCCCGACCACTACTTCGCCCTGGTGTCCAGGTACTACGCCTACGACCCCATCAGCAAGGA
GATGATCGCCCTGAAGGACGAGACCAACCCCATCGAGGAGTGGCAGCACATCGAGCAGC
TGAAGGGCAGCGCCGAGGGCAGCATCAGATACCCCGCCTGGAACGGCATCATCAGCCAG
GAGGTGCTGGACTACCTGAGCAGCTACATCAACAGGCGGATCTGA (SEQ ID NO: 343)

Improved Cre recombinase (iCre):
ATGGTGCCCAAGAAGAAGAGGAAAGTCTCCAACCTGCTGACTGTGCACCAAAACCTGCCT
GCCCTCCCTGTGGATGCCACCTCTGATGAAGTCAGGAAGAACCTGATGGACATGTTCAGG
GACAGGCAGGCCTTCTCTGAACACACCTGGAAGATGCTCCTGTCTGTGTGCAGATCCTGG
GCTGCCTGGTGCAAGCTGAACAACAGGAAATGGTTCCCTGCTGAACCTGAGGATGTGAGG
GACTACCTCCTGTACCTGCAAGCCAGAGGCCTGGCTGTGAAGACCATCCAACAGCACCTG
GGCCAGCTCAACATGCTGCACAGGAGATCTGGCCTGCCTCGCCCTTCTGACTCCAATGCT

FIG. 27 cont'd

GTGTCCCTGGTGATGAGGAGAATCAGAAAGGAGAATGTGGATGCTGGGGAGAGAGCCAA
GCAGGCCCTGGCCTTTGAACGCACTGACTTTGACCAAGTCAGATCCCTGATGGAGAACTC
TGACAGATGCCAGGACATCAGGAACCTGGCCTTCCTGGGCATTGCCTACAACACCCTGCT
GCGCATTGCCGAAATTGCCAGAATCAGAGTGAAGGACATCTCCCGCACCGATGGTGGGAG
AATGCTGATCCACATTGGCAGGACCAAGACCCTGGTGTCCACAGCTGGTGTGGAGAAGGC
CCTGTCCCTGGGGGGTTACCAAGCTGGTGGAGAGATGGATCTCTGTGTCTGGTGTGGCTGA
TGACCCCAACAACTACCTGTTCTGCCGGGTCAGAAAGAATGGTGTGGCTGCCCCTTCTGC
CACCTCCCAACTGTCCACCCGGGCCCTGGAAGGGATCTTTGAGGCCACCCACCGCCTGAT
CTATGGTGCCAAGGATGACTCTGGGCAGAGATACCTGGCCTGGTCTGGCCACTCTGCCAG
AGTGGGTGCTGCCAGGGACATGGCCAGGGCTGGTGTGTCCATCCCTGAAATCATGCAGG
CTGGTGGCTGGACCAATGTGAACATTGTGATGAACTACATCAGAAACCTGGACTCTGAGAC
TGGGGCCATGGTGAGGCTGCTCGAGGATGGGGACTAA (SEQ ID NO: 344)

SP10 insulator (SP10ins):
GAAGCTACCCCTAACACACTATTCTACACACAGAAAATGCTCTTCACTAG (SEQ ID NO: 345)

3xSP10ins:
GAAGCTACCCCTAACACACTATTCTACACACAGAAAATGCTCTTCACTAGGAAGCTACCCC
TAACACACTATTCTACACACAGAAAATGCTCTTCACTAGGAAGCTACCCCTAACACACTATT
CTACACACAGAAAATGCTCTTCACTAG (SEQ ID NO: 346)

WPRE3:
ATAATCAACCTCTGGATTACAAAATTTGTGAAAGATTGACTGGTATTCTTAACTATGTTGCTC
CTTTTACGCTATGTGGATACGCTGCTTTAATGCCTTTGTATCATGCTATTGCTTCCCGTATG
GCTTTCATTTTCTCCTCCTTGTATAAATCCTGGTTAGTTCTTGCCACGGCGGAACTCATCGC
CGCCTGCCTTGCCCGCTGCTGGACAGGGGCTCGGCTGTTGGGCACTGACAATTCCGTGG
(SEQ ID NO: 347)

WPRE:
GCTTATCGATAATCAACCTCTGGATTACAAAATTTGTGAAAGATTGACTGGTATTCTTAACTA
TGTTGCTCCTTTTACGCTATGTGGATACGCTGCTTTAATGCCTTTGTATCATGCTATTGCTT
CCCGTATGGCTTTCATTTTCTCCTCCTTGTATAAATCCTGGTTGCTGTCTCTTTATGAGGAG
TTGTGGCCCGTTGTCAGGCAACGTGGCGTGGTGTGCACTGTGTTTGCTGACGCAACCCCC
ACTGGTTGGGGCATTGCCACCACCTGTCAGCTCCTTTCCGGGACTTTCGCTTTCCCCCTCC
CTATTGCCACGGCGGAACTCATCGCCGCCTGCCTTGCCCGCTGCTGGACAGGGGCTCGG
CTGTTGGGCACTGACAATTCCGTGGTGTTGTCGGGGAAATCATCGTCCTTTCCTTGGCTGC
TCGCCTATGTTGCCACCTGGATTCTGCGCGGGACGTCCTTCTGCTACGTCCCTTCGGCCC
TCAATCCAGCGGACCTTCCTTCCCGCGGCCTGCTGCCGGCTCTGCGGCCTCTTCCGCGTC
TTCGCCTTCGCCCTCAGACGAGTCGGATCTCCCTTTGGGCCGCCTCCCCGCATCGATACC
G (SEQ ID NO: 348)

BGHpA:
CGACTGTGCCTTCTAGTTGCCAGCCATCTGTTGTTTGCCCCTCCCCCGTGCCTTCCTTGAC
CCTGGAAGGTGCCACTCCCACTGTCCTTTCCTAATAAAATGAGGAAATTGCATCGCATTGT
CTGAGTAGGTGTCATTCTATTCTGGGGGGTGGGGTGGGGCAGGACAGCAAGGGGGAGGA
TTGGGAAGACAATAGCAGGCATG (SEQ ID NO: 349)

HGHpA:
ACGGGTGGCATCCCTGTGACCCCTCCCCAGTGCCTCTCCTGGCCCTGGAAGTTGCCACTC
CAGTGCCCACCAGCCTTGTCCTAATAAAATTAAGTTGCATCATTTTGTCTGACTAGGTGTCC
TTCTATAATATTATGGGGTGGAGGGGGGTGGTATGGAGCAAGGGGCAAGTTGGGAAGACA

FIG. 27 cont'd

ACCTGTAGGGCCTGCGGGGTCTATTGGGAACCAAGCTGGAGTGCAGTGGCACAATCTTGG
CTCACTGCAATCTCCGCCTCCTGGGTTCAAGCGATTCTCCTGCCTCAGCCTCCCGAGTTGT
TGGGATTCCAGGCATGCATGACCAGGCTCAGCTAATTTTTGTTTTTTTGGTAGAGACGGGG
TTTCACCATATTGGCCAGGCTGGTCTCCAACTCCTAATCTCAGGTGATCTACCCACCTTGG
CCTCCCAAATTGCTGGGATTACAGGCGTGAACCACTGCTCCCTTCCCTGTCCTT (SEQ ID
NO: 350)

P2A:
GGCAGCGGCGCCACCAACTTCAGCCTGCTGAAGCAGGCCGGCGACGTGGAGGAGAACCC
CGGCCCCGGAGCTAGCGGA (SEQ ID NO: 351)

T2A:
(GSG)EGRGSLLTCGDVEENPGP (SEQ ID NO: 352)

E2A:
(GSG)QCTNYALLKLAGDVESNPGPP (SEQ ID NO: 353)

F2A:
(GSG)VKQTLNFDLLKLAGDVESNPGP (SEQ ID NO: 354)

PHP.eB capsid:
MAADGYLPDWLEDNLSEGIREWWALKPGAPQPKANQQHQDNARGLVLPGYKYLGPGNGLDK
GEPVNAADAAALEHDKAYDQQLKAGDNPYLKYNHADAEFQERLKEDTSFGGNLGRAVFQAKK
RLLEPLGLVEEAAKTAPGKKRPVEQSPQEPDSSAGIGKSGAQPAKKRLNFGQTGDTESVPDP
QPIGEPPAAPSGVGSLTMASGGGAPVADNNEGADGVGSSSGNWHCDSQWLGDRVITTSTRT
WALPTYNNHLYKQISNSTSGGSSNDNAYFGYSTPWGYFDFNRFHCHFSPRDWQRLINNNWG
FRPKRLNFKLFNIQVKEVTDNNGVKTIANNLTSTVQVFTDSDYQLPYVLGSAHEGCLPPFPADV
FMIPQYGYLTLNDGSQAVGRSSFYCLEYFPSQMLRTGNNFQFSYEFENVPFHSSYAHSQSLD
RLMNPLIDQYLYYLSKTINGSGQNQQTLKFSVAGPSNMAVQGRNYIPGPSYRQQRVSTTVTQN
NNSEFAWPGASSWALNGRNSLMNPGPAMASHKEGEDRFFPLSGSLIFGKQGTGRDNVDADK
VMITNEEEIKTTNPVATESYGQVATNHQS<u>DGTLAVPFK</u>AQAQTGWVQNQGILPGMVWQDRDV
YLQGPIWAKIPHTDGNFHPSPLMGGFGMKHPPPQILIKNTPVPADPPTAFNKDKLNSFITQYST
GQVSVEIEWELQKENSKRWNPEIQYTSNYYKSNNVEFAVNTEGVYSEPRPIGTRYLTRNL
(SEQ ID NO: 355)

AAV9 VP1 capsid protein:
MAADGYLPDWLEDNLSEGIREWWALKPGAPQPKANQQHQDNARGLVLPGYKYLGPGNGLDK
GEPVNAADAAALEHDKAYDQQLKAGDNPYLKYNHADAEFQERLKEDTSFGGNLGRAVFQAKK
RLLEPLGLVEEAAKTAPGKKRPVEQSPQEPDSSAGIGKSGAQPAKKRLNFGQTGDTESVPDP
QPIGEPPAAPSGVGSLTMASGGGAPVADNNEGADGVGSSSGNWHCDSQWLGDRVITTSTRT
WALPTYNNHLYKQISNSTSGGSSNDNAYFGYSTPWGYFDFNRFHCHFSPRDWQRLINNNWG
FRPKRLNFKLFNIQVKEVTDNNGVKTIANNLTSTVQVFTDSDYQLPYVLGSAHEGCLPPFPADV
FMIPQYGYLTLNDGSQAVGRSSFYCLEYFPSQMLRTGNNFQFSYEFENVPFHSSYAHSQSLD
RLMNPLIDQYLYYLSKTINGSGQNQQTLKFSVAGPSNMAVQGRNYIPGPSYRQQRVSTTVTQN
NNSEFAWPGASSWALNGRNSLMNPGPAMASHKEGEDRFFPLSGSLIFGKQGTGRDNVDADK
VMITNEEEIKTTNPVATESYGQVATNHQSAQAQAQTGWVQNQGILPGMVWQDRDVYLQGPIW
AKIPHTDGNFHPSPLMGGFGMKHPPPQILIKNTPVPADPPTAFNKDKLNSFITQYSTGQVSVEIE
WELQKENSKRWNPEIQYTSNYYKSNNVEFAVNTEGVYSEPRPIGTRYLTRNL (SEQ ID NO:
356)

FIG. 27 cont'd tet-Transactivator version 2 (tTA2):
ATGTCTAGACTGGACAAGAGCAAAGTCATAAACTCTGCTCTGGAATTACTCAATGAAGTCG
GTATCGAAGGCCTGACGACAAGGAAACTCGCTCAAAAGCTGGGAGTTGAGCAGCCTACCC
TGTACTGGCACGTGAAGAACAAGCGGGCCCTGCTCGATGCCCTGGCAATCGAGATGCTGG
ACAGGCATCATACCCACTTCTGCCCCCTGGAAGGCGAGTCATGGCAAGACTTTCTGCGGA
ACAACGCCAAGTCATTCCGCTGTGCTCTCCTCTCACATCGCGACGGGGCTAAAGTGCATCT
CGGCACCCGCCCAACAGAGAAACAGTACGAAACCCTGGAAAATCAGCTCGCGTTCCTGTG
TCAGCAAGGCTTCTCCCTGGAGAACGCACTGTACGCTCTGTCCGCCGTGGGCCACTTTAC
ACTGGGCTGCGTATTGGAGGATCAGGAGCATCAAGTAGCAAAAGAGGAAAGAGAGACACC
TACCACCGATTCTATGCCCCCACTTCTGAGACAAGCAATTGAGCTGTTCGACCATCAGGGA
GCCGAACCTGCCTTCCTTTTCGGCCTGGAACTAATCATATGTGGCCTGGAGAAACAGCTAA
AGTGCGAAAGCGGCGGGCCGGCCGACGCCCTTGACGATTTTGACTTAGACATGCTCCCAG
CCGATGCCCTTGACGACTTTGACCTTGATATGCTGCCTGCTGACGCTCTTGACGATTTTGA
CCTTGACATGCTCCCCGGGTAA (SEQ ID NO: 357)

Exemplary Plasmid Backbone 1 – Left ITR:
CCTGCAGGCAGCTGCGCGCTCGCTCGCTCACTGAGGCCGCCCGGGCGTCGGGCGACCTT
TGGTCGCCCGGCCTCAGTGAGCGAGCGAGCGCGCAGAGAGGGAGTGGCCAACTCCATCA
CTAGGGGTTCCT (SEQ ID NO: 358)

Exemplary Plasmid Backbone 1 – Right ITR:
CCTGCAGGCAGCTGCGCGCTCGCTCGCTCACTGAGGCCGCCCGGGCAAAGCCCGGGCG
TCGGGCGACCTTTGGTCGCCCGGCCTCAGTGAGCGAGCGAGCGCGCAGAGAGGGAGTG
GCCAACTCCATCACTAGGGGTTCCT (SEQ ID NO: 359)

Exemplary Plasmid Backbone 2 – Left ITR:
CATGTCCTGCAGGCAGCTGCGCGCTCGCTCGCTCACTGAGGCCGCCCGGGCAAAGCCCG
GGCGTCGGGCGACCTTTGGTCGCCCGGCCTCAGTGAGCGAGCGAGCGCGCAGAGAGGG
AGTGGCCAACTCCATCACTAGGGGTTCCT (SEQ ID NO: 360)

Exemplary Plasmid Backbone 2 – Right ITR:
AGGAACCCCTAGTGATGGAGTTGGCCACTCCCTCTCTGCGCGCTCGCTCGCTCACTGAGG
CCGGGCGACCAAAGGTCGCCCGACGCCCGGGCTTTGCCCGGGCGGCCTCAGTGAGCGA
GCGAGCGCGCAGCTGCCTGCAGGGGCGCCTG (SEQ ID NO: 361)

GTPase HRas:
MTEYKLVVVGAGGVGKSALTIQLIQNHFVDEYDPTIEDSYRKQVVIDGETCLLDILDTAGQEEYS
AMRDQYMRTGEGFLCVFAINNTKSFEDIHQYREQIKRVKDSDDVPMVLVGNKCDLAARTVESR
QAQDLARSYGIPYIETSAKTRQGVEDAFYTLVREIRQHKLRKLNPPDESGPGCMSCKCVLS
(SEQ ID NO: 362)

GCaMP6m
ATGGGTTCTCATCATCATCATCATCATGGTATGGCTAGCATGACTGGTGGACAGCAAATGG
GTCGGGATCTGTACGACGATGACGATAAGGATCTCGCCACCATGGTCGACTCATCACGTC
GTAAGTGGAATAAGACAGGTCACGCAGTCAGAGCTATAGGTCGGCTGAGCTCACTCGAGA
ACGTCTATATCAAGGCCGACAAGCAGAAGAACGGCATCAAGGCGAACTTCAAGATCCGCC
ACAACATCGAGGACGGCGGCGTGCAGCTCGCCTACCACTACCAGCAGAACACCCCCATC
GGCGACGGCCCCGTGCTGCTGCCCGACAACCACTACCTGAGCGTGCAGTCCAAACTTTCG
AAAGACCCCAACGAGAAGCGCGATCACATGGTCCTGCTGGAGTTCGTGACCGCCGCCGG
GATCACTCTCGGCATGGACGAGCTGTACAAGGGCGGTACCGGAGGGAGCATGGTGAGCA
AGGGCGAGGAGCTGTTCACCGGGGTGGTGCCCATCCTGGTCGAGCTGGACGGCGACGTA

FIG. 27 cont'd

AACGGCCACAAGTTCAGCGTGTCCGGCGAGGGTGAGGGCGATGCCACCTACGGCAAGCT
GACCCTGAAGTTCATCTGCACCACCGGCAAGCTGCCCGTGCCCTGGCCCACCCTCGTGAC
CACCCTGACCTACGGCGTGCAGTGCTTCAGCCGCTACCCCGACCACATGAAGCAGCACGA
CTTCTTCAAGTCCGCCATGCCCGAAGGCTACATCCAGGAGCGCACCATCTTCTTCAAGGAC
GACGGCAACTACAAGACCCGCGCCGAGGTGAAGTTCGAGGGCGACACCCTGGTGAACCG
CATCGAGCTGAAGGGCATCGACTTCAAGGAGGACGGCAACATCCTGGGGCACAAGCTGG
AGTACAACCTGCCGGACCAACTGACTGAAGAGCAGATCGCAGAATTTAAAGAGGCTTTCTC
CCTATTTGACAAGGACGGGGATGGGACAATAACAACCAAGGAGCTGGGGACGGTGATGC
GGTCTCTGGGGCAGAACCCCACAGAAGCAGAGCTGCAGGACATGATCAATGAAGTAGATG
CCGACGGTGACGGCACAATCGACTTCCCTGAGTTCCTGACAATGATGGCAAGAAAAGGGA
GCTACAGGGACACGGAAGAAGAAATTAGAGAAGCGTTCGGTGTGTTTGATAAGGATGGCA
ATGGCTACATCAGTGCAGCAGAGCTTCGCCACGTGATGACAAACCTTGGAGAGAAGTTAA
CAGATGAAGAGGTTGATGAAATGATCAGGGAAGCAGACATCGATGGGGATGGTCAGGTAA
ACTACGAAGAGTTTGTACAAATGATGACAGCGAAGTGA (SEQ ID NO: 363)

GCaMP6s

ATGGGTTCTCATCATCATCATCATCATGGTATGGCTAGCATGACTGGTGGACAGCAAATGG
GTCGGGATCTGTACGACGATGACGATAAGGATCTCGCCACCATGGTCGACTCATCACGTC
GTAAGTGGAATAAGACAGGTCACGCAGTCAGAGCTATAGGTCGGCTGAGCTCACTCGAGA
ACGTCTATATCAAGGCCGACAAGCAGAAGAACGGCATCAAGGCGAACTTCCACATCCGCC
ACAACATCGAGGACGGCGGCGTGCAGCTCGCCTACCACTACCAGCAGAACACCCCCATC
GGCGACGGCCCCGTGCTGCTGCCCGACAACCACTACCTGAGCGTGCAGTCCAAACTTTCG
AAAGACCCCAACGAGAAGCGCGATCACATGGTCCTGCTGGAGTTCGTGACCGCCGCCGG
GATCACTCTCGGCATGGACGAGCTGTACAAGGGCGGTACCGGAGGGAGCATGGTGAGCA
AGGGCGAGGAGCTGTTCACCGGGGTGGTGCCCATCCTGGTCGAGCTGGACGGCGACGTA
AACGGCCACAAGTTCAGCGTGTCCGGCGAGGGTGAGGGCGATGCCACCTACGGCAAGCT
GACCCTGAAGTTCATCTGCACCACCGGCAAGCTGCCCGTGCCCTGGCCCACCCTCGTGAC
CACCCTGACCTACGGCGTGCAGTGCTTCAGCCGCTACCCCGACCACATGAAGCAGCACGA
CTTCTTCAAGTCCGCCATGCCCGAAGGCTACATCCAGGAGCGCACCATCTTCTTCAAGGAC
GACGGCAACTACAAGACCCGCGCCGAGGTGAAGTTCGAGGGCGACACCCTGGTGAACCG
CATCGAGCTGAAGGGCATCGACTTCAAGGAGGACGGCAACATCCTGGGGCACAAGCTGG
AGTACAACCTGCCGGACCAACTGACTGAAGAGCAGATCGCAGAATTTAAAGAGGCTTTCTC
CCTATTTGACAAGGACGGGGATGGGACAATAACAACCAAGGAGCTGGGGACGGTGATGC
GGTCTCTGGGGCAGAACCCCACAGAAGCAGAGCTGCAGGACATGATCAATGAAGTAGATG
CCGACGGTGACGGCACAATCGACTTCCCTGAGTTCCTGACAATGATGGCAAGAAAAATGA
AATACAGGGACACGGAAGAAGAAATTAGAGAAGCGTTCGGTGTGTTTGATAAGGATGGCA
ATGGCTACATCAGTGCAGCAGAGCTTCGCCACGTGATGACAAACCTTGGAGAGAAGTTAA
CAGATGAAGAGGTTGATGAAATGATCAGGGAAGCAGACATCGATGGGGATGGTCAGGTAA
ACTACGAAGAGTTTGTACAAATGATGACAGCGAAGTGA (SEQ ID NO: 364)

GCaMP6f

ATGGGTTCTCATCATCATCATCATCATGGTATGGCTAGCATGACTGGTGGACAGCAAATGG
GTCGGGATCTGTACGACGATGACGATAAGGATCTCGCCACCATGGTCGACTCATCACGTC
GTAAGTGGAATAAGACAGGTCACGCAGTCAGAGCTATAGGTCGGCTGAGCTCACTCGAGA
ACGTCTATATCAAGGCCGACAAGCAGAAGAACGGCATCAAGGCGAACTTCAAGATCCGCC
ACAACATCGAGGACGGCGGCGTGCAGCTCGCCTACCACTACCAGCAGAACACCCCCATC
GGCGACGGCCCCGTGCTGCTGCCCGACAACCACTACCTGAGCGTGCAGTCCAAACTTTCG
AAAGACCCCAACGAGAAGCGCGATCACATGGTCCTGCTGGAGTTCGTGACCGCCGCCGG
GATCACTCTCGGCATGGACGAGCTGTACAAGGGCGGTACCGGAGGGAGCATGGTGAGCA
AGGGCGAGGAGCTGTTCACCGGGGTGGTGCCCATCCTGGTCGAGCTGGACGGCGACGTA
AACGGCCACAAGTTCAGCGTGTCCGGCGAGGGTGAGGGCGATGCCACCTACGGCAAGCT

FIG. 27 cont'd

GACCCTGAAGTTCATCTGCACCACCGGCAAGCTGCCCGTGCCCTGGCCCACCCTCGTGAC
CACCCTGACCTACGGCGTGCAGTGCTTCAGCCGCTACCCCGACCACATGAAGCAGCACGA
CTTCTTCAAGTCCGCCATGCCCGAAGGCTACATCCAGGAGCGCACCATCTTCTTCAAGGAC
GACGGCAACTACAAGACCCGCGCCGAGGTGAAGTTCGAGGGCGACACCCTGGTGAACCG
CATCGAGCTGAAGGGCATCGACTTCAAGGAGGACGGCAACATCCTGGGGCACAAGCTGG
AGTACAACCTGCCGGACCAACTGACTGAAGAGCAGATCGCAGAATTTAAAGAGGAATTCTC
CCTATTTGACAAGGACGGGGATGGGACAATAACAACCAAGGAGCTGGGGACGGTGATGC
GGTCTCTGGGGCAGAACCCCACAGAAGCAGAGCTGCAGGACATGATCAATGAAGTAGATG
CCGACGGTGACGGCACAATCGACTTCCCTGAGTTCCTGACAATGATGGCAAGAAAAATGA
AATACAGGGACACGGAAGAAGAAATTAGAGAAGCGTTCGGTGTGTTTGATAAGGATGGCA
ATGGCTACATCAGTGCAGCAGAGCTTCGCCACGTGATGACAAACCTTGGAGAGAAGTTAA
CAGATGAAGAGGTTGATGAAATGATCAGGGAAGCAGACATCGATGGGGATGGTCAGGTAA
ACTACGAAGAGTTTGTACAAATGATGACAGCGAAGTGA (SEQ ID NO: 365)

1

ARTIFICIAL EXPRESSION CONSTRUCTS FOR SELECTIVELY MODULATING GENE EXPRESSION IN NON-NEURONAL BRAIN CELLS

CROSS-REFERENCE TO RELATED APPLICATION

This application is a U.S. National Phase application based on International Patent Application No. PCT/US2021/024525, filed on Mar. 26, 2021, which claims priority to U.S. Provisional Patent Application No. 63/001,159 filed on Mar. 27, 2020, each of which is incorporated herein by reference in its entirety as if fully set forth herein.

STATEMENT REGARDING FEDERALLY SPONSORED RESEARCH OR DEVELOPMENT

This invention was made with government support under MH114126 and DA036909 awarded by the National Institutes of Health. The government has certain rights in the invention.

REFERENCE TO SEQUENCE LISTING

The Sequence Listing associated with this application is provided in text format in lieu of a paper copy, and is hereby incorporated by reference into the specification. The name of the text file containing the Sequence Listing is 2RL5272_ST25.bd. The text is 680 KB, was created on Sep. 16, 2022, and is being submitted electronically via EFS-Web.

FIELD OF THE DISCLOSURE

The current disclosure provides artificial expression constructs for selectively modulating gene expression in selected central nervous system cell types. The artificial expression constructs can be used to selectively express synthetic genes or modify gene expression in non-neuronal brain cells including astrocytes, oligodendrocytes, microglia, pericytes, SMC, and endothelial cells.

BACKGROUND OF THE DISCLOSURE

To fully understand the biology of the brain, different cell types need to be distinguished and defined and, to further study them, artificial expression constructs that can selectively label and perturb them need to be identified. In mouse, recombinase driver lines have been used to great effect to label cell populations that share marker gene expression. However, the creation, maintenance, and use of such lines that label cell types with high specificity can be costly, frequently requiring triple transgenic crosses, which yield a low frequency of experimental animals. Furthermore, those tools require germline transgenic animals and thus are not applicable to humans.

SUMMARY OF THE DISCLOSURE

The current disclosure provides artificial expression constructs that selectively drive gene expression in targeted central nervous system cell populations. Targeted central nervous system cell populations include: non-neuronal brain cells including astrocytes, oligodendrocytes, microglia, pericytes, SMC, and endothelial cells.

Particular embodiments of the artificial expression constructs utilize the following enhancers to selectively drive protein expression within targeted central nervous system cell populations as follows:

astrocytes: eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, and mscRE1007;

L1 interlaminar astrocytes: eHGT_267h, eHGT_268h, eHGT_269h, eHGT_270h, eHGT_271h, eHGT_272h, eHGT_273h, eHGT_274h, eHGT_275h, eHGT_276h, eHGT_315h, and eHGT_316h;

oligodendrocytes: eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, and eHGT_408h;

microglia: eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, and eHGT_430h;

pericytes: mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, and mscRE1037;

SMC: mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, and mscRE1052;

endothelial cells: mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, and mscRE1022.

Particular embodiments provide artificial expression constructs including the features of vectors described herein including vectors: CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155,

3

CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, and 3052.

BRIEF DESCRIPTION OF THE FIGURES

Some of the drawings submitted herein are better understood in color. Applicant considers the color versions of the drawings as part of the original submission and reserves the right to present color images of the drawings in later proceedings.

Figure 1:
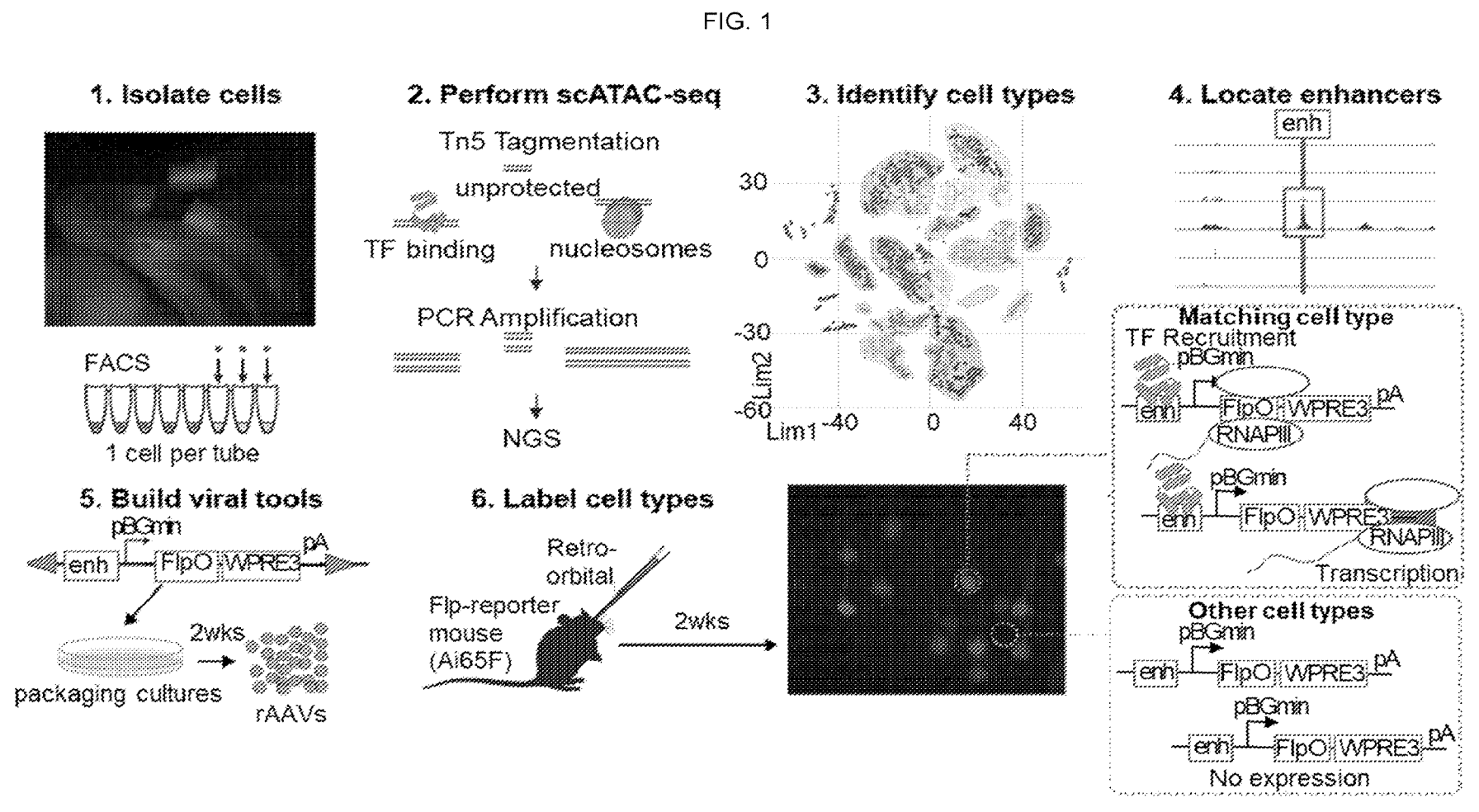

FIG. 1: Overview of enhancer discovery for viral tools. To build cell type-specific labeling tools, cells from adult mouse cortex were isolated and a single cell assay for transposase-accessible chromatin using sequencing (scATAC-seq) was performed. Samples were clustered and compared to single cell RNA sequencing (scRNA-seq) datasets to identify the clusters. Single cells matching the same transcriptomic types were then pooled and the genome was searched for type-specific putative enhancers. These regions were cloned upstream of a minimal promoter in an AAV genomic backbone, which was used to generate self-complementary adeno-associated viral vectors (scAAVs) or recombinant adeno-associated viral vectors (rAAVs). These viral tools were delivered retro-orbitally to label specific cortical populations. In cells with a matching cell type, enhancers recruit their cognate transcription factors to drive cell type-specific expression. In other cells, viral genomes are present, but transcripts are not expressed.

FIG. 2. Brain regions and cell subclasses selectively labeled by different artificial expression constructs of the disclosure.

FIG. 3E, 3F: Native SYFP2 fluorescence after intraparenchymal injection of CN2089 packaged by PHP.eB into the cortex of a macaque non-human primate. Native SYFP2 alone (3E) and co-stained with DAPI and propidium iodide (3F) is shown. Note most cells display a pronounced astrocyte morphology. This data shows eHGT_390m enhancer maintains astrocyte selectivity in macaque neocortex.

Figure 3A:
FIGS. 3A, 3B: Native SYFP2 fluorescence montage of a sagittal section of a whole mouse brain (3A) and visual cortex (3B) showing selective expression of SYFP in cells with astrocyte morphology after retro-orbital injection of CN2089 virus packaged with the PHP.eB capsid. This data shows that the eHGT_390m enhancer drives reporter expression selectively in mouse astrocytes.
Figure 3B:
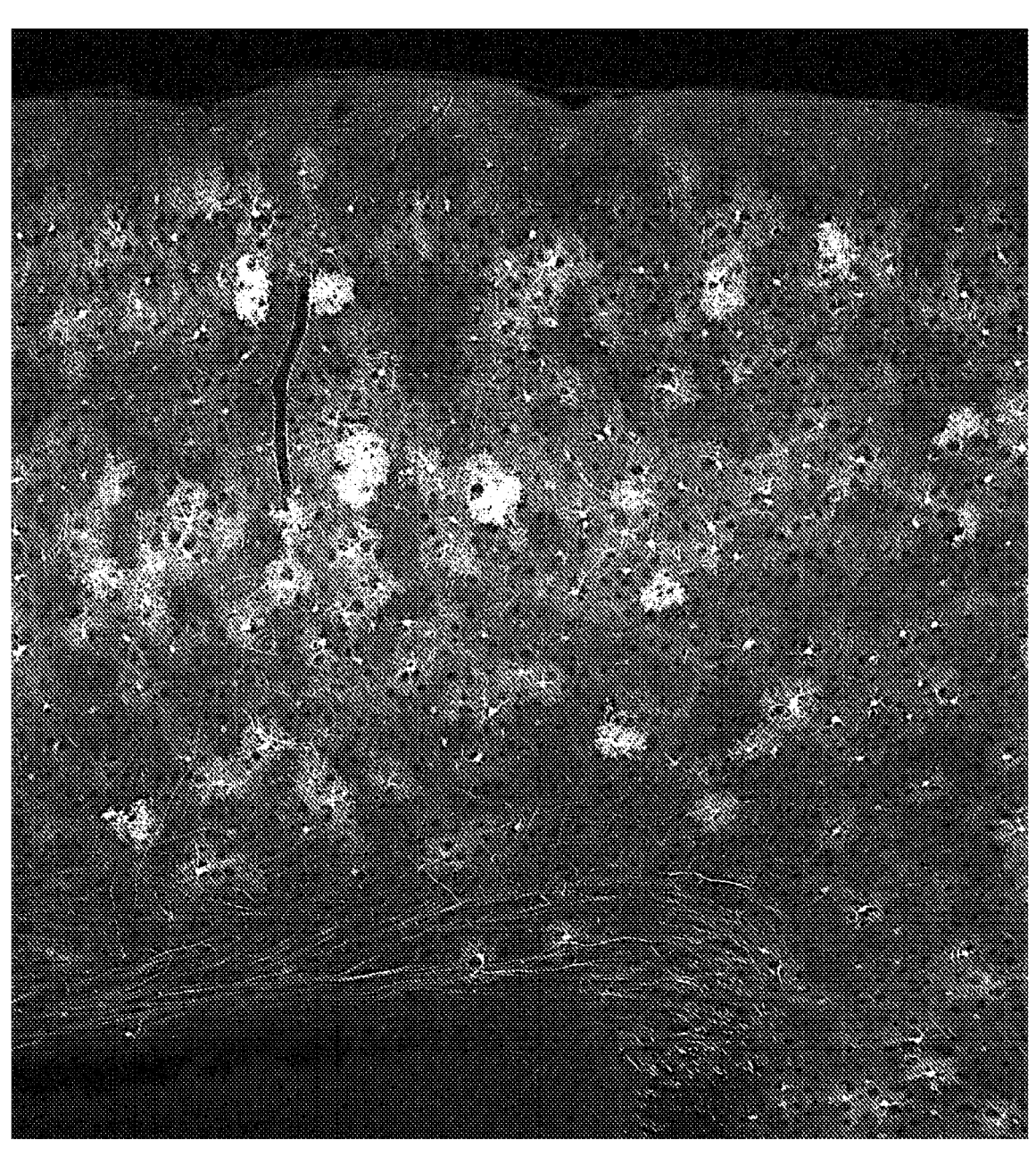
Figure 3C:
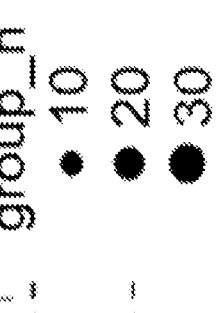
FIG. 3C: Mapping of single cell transcriptomic profiles of SYPF2+ cells sorted from the VISp region of the mouse cortex after retro-orbital injection of CN2089 virus packaged with the PHP.eB capsid. Number of cells mapped to the final leaf are shown on the bar plot below the dendrogram. Transcriptomic cell types are shown on the bottom. This data shows eHGT_390m enhancer driven reporter expression occurs selectively in mouse astrocytes when VISp is evaluated (>95% of labeled cells).
Figure 3C:
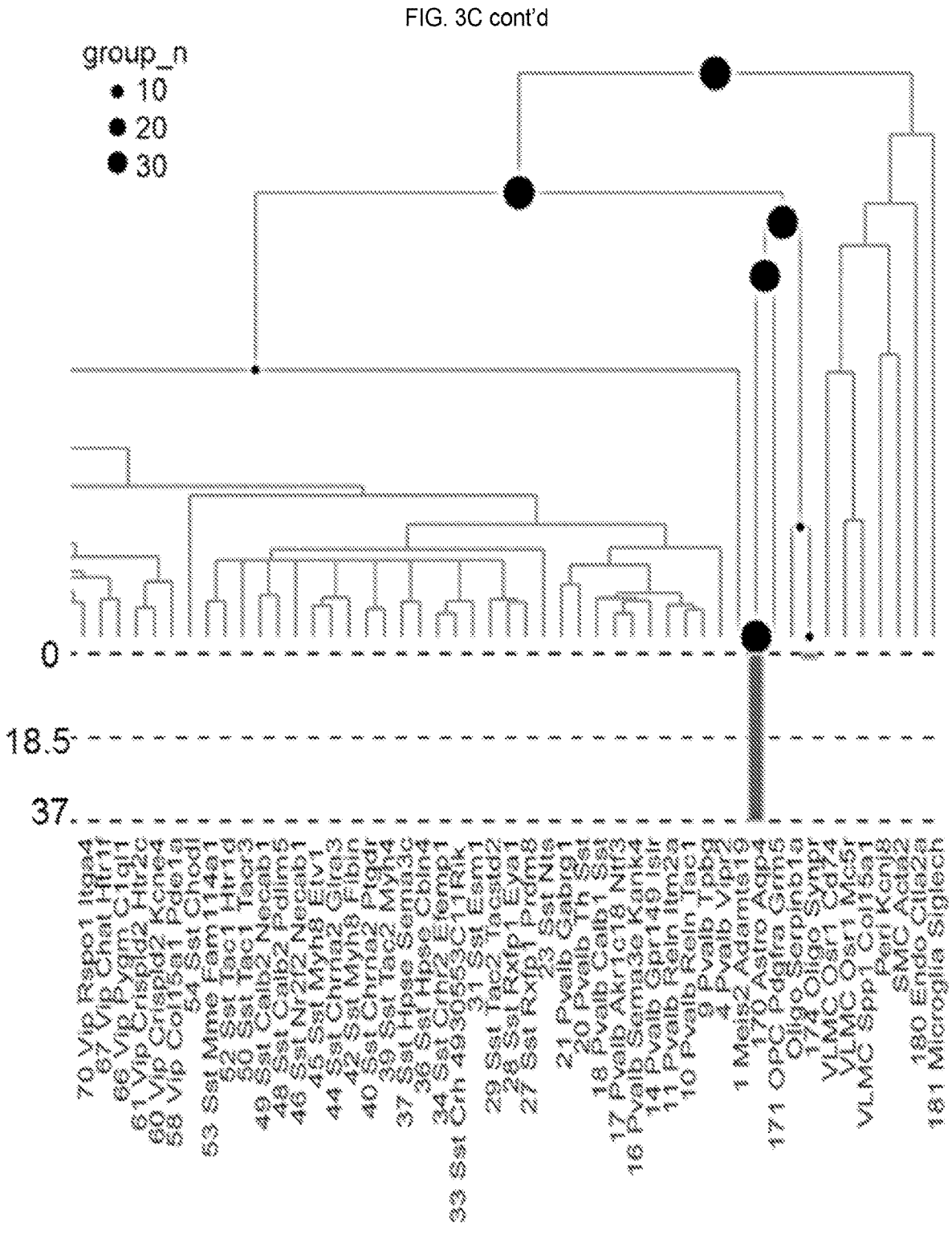
Figure 3D:
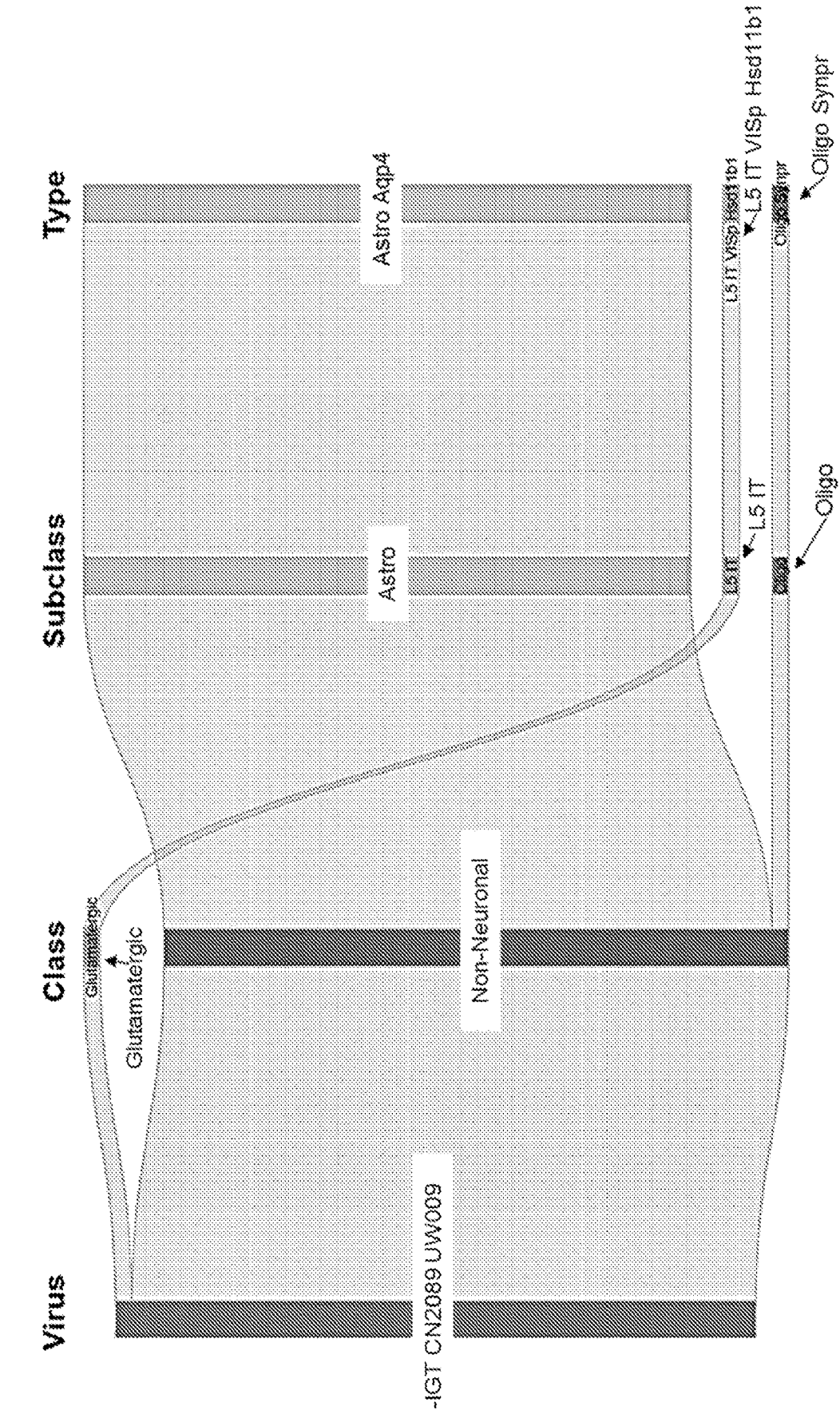
FIG. 3D: River plot of single cell transcriptomic profiles of SYPF2+ cells sorted from the VISp region of the mouse cortex after retro-orbital injection of CN2089 virus packaged with the PHP.eB capsid. Mapping of cells to cell class, subclass, and type is shown. This data shows eHGT_390m enhancer driven reporter expression occurs selectively in mouse astrocytes when VISp is evaluated (>95% of labeled cells).
Figure 3E:
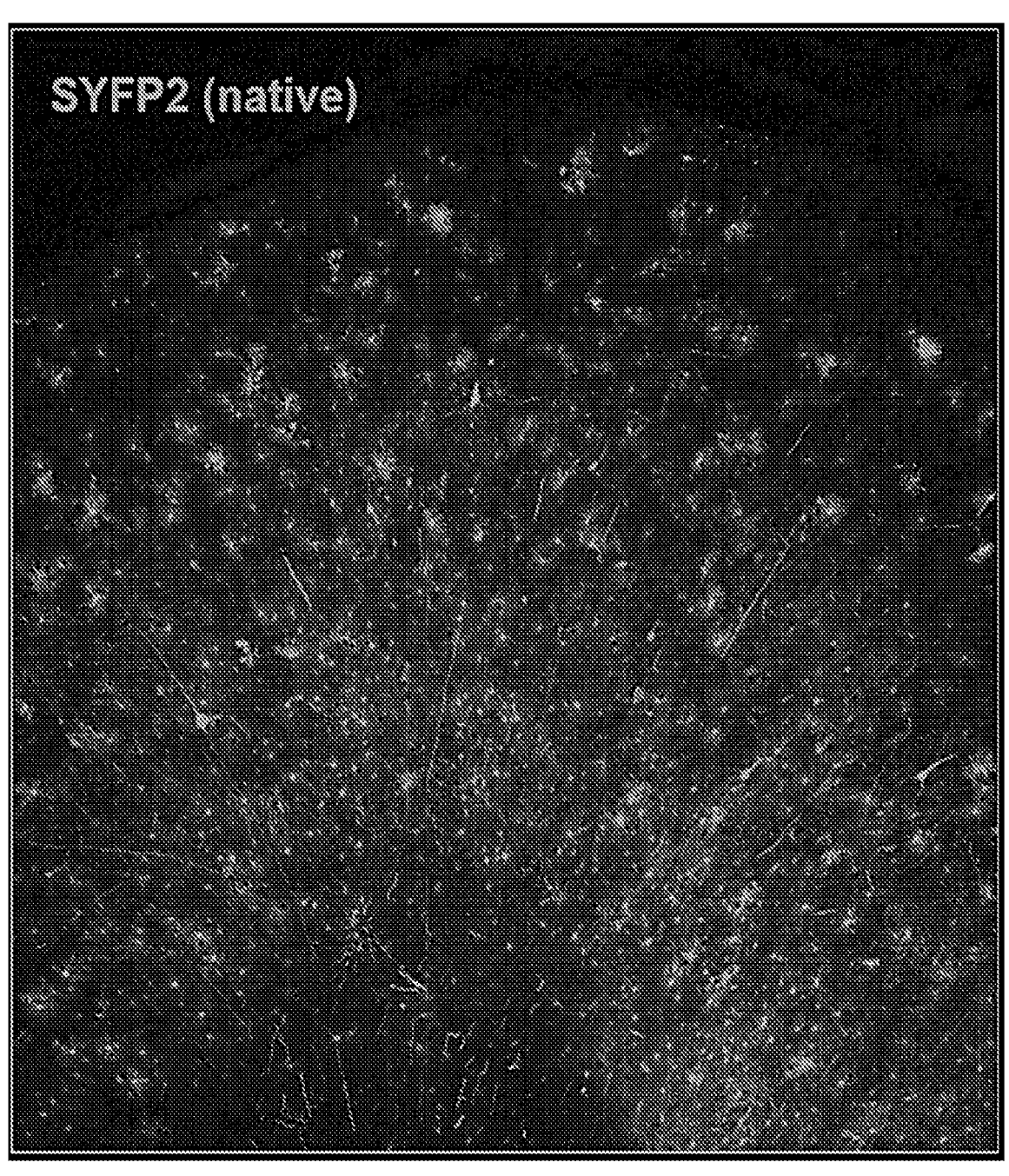
Figure 3F:
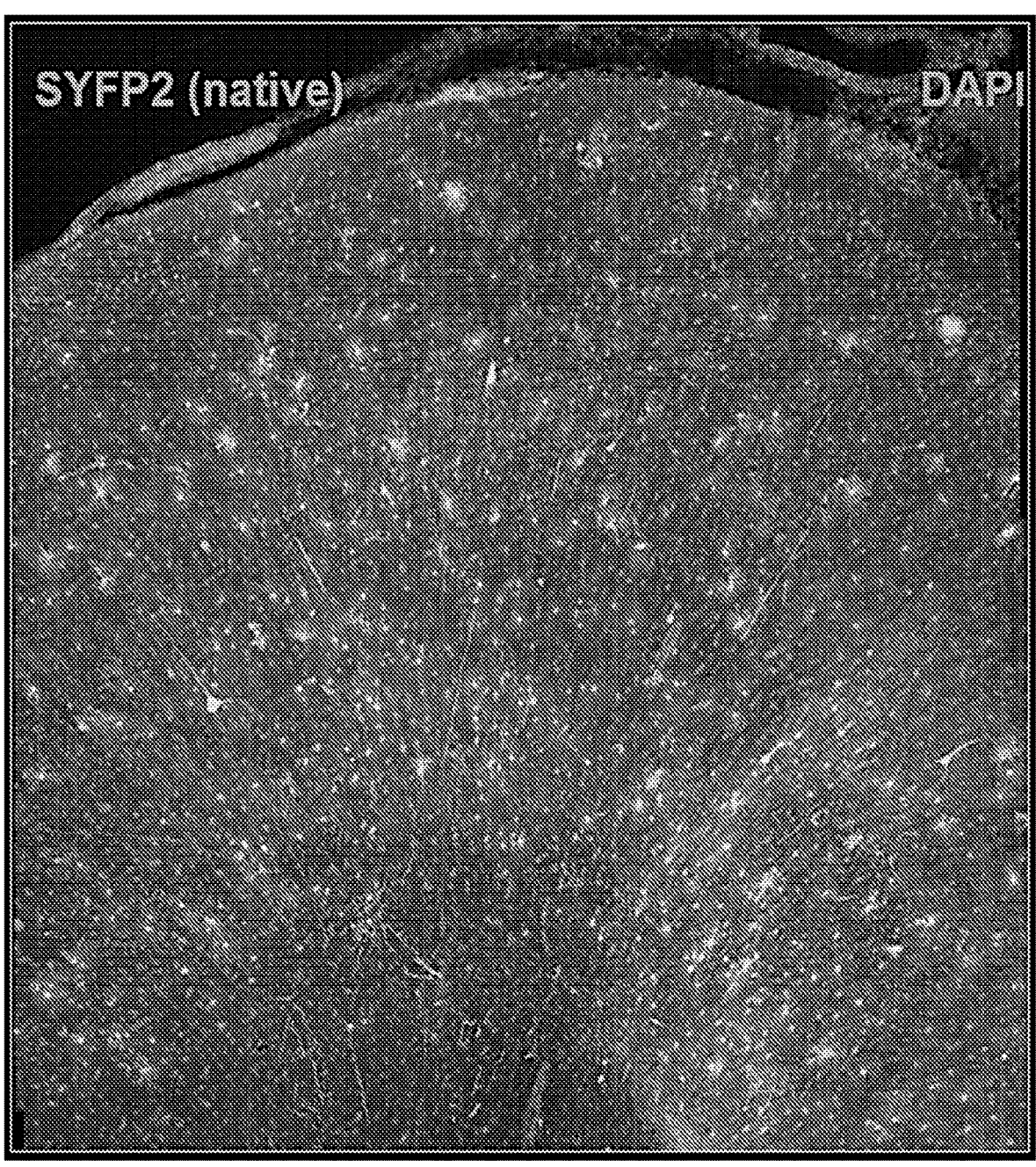
Figures 3G, 3H, 3I:
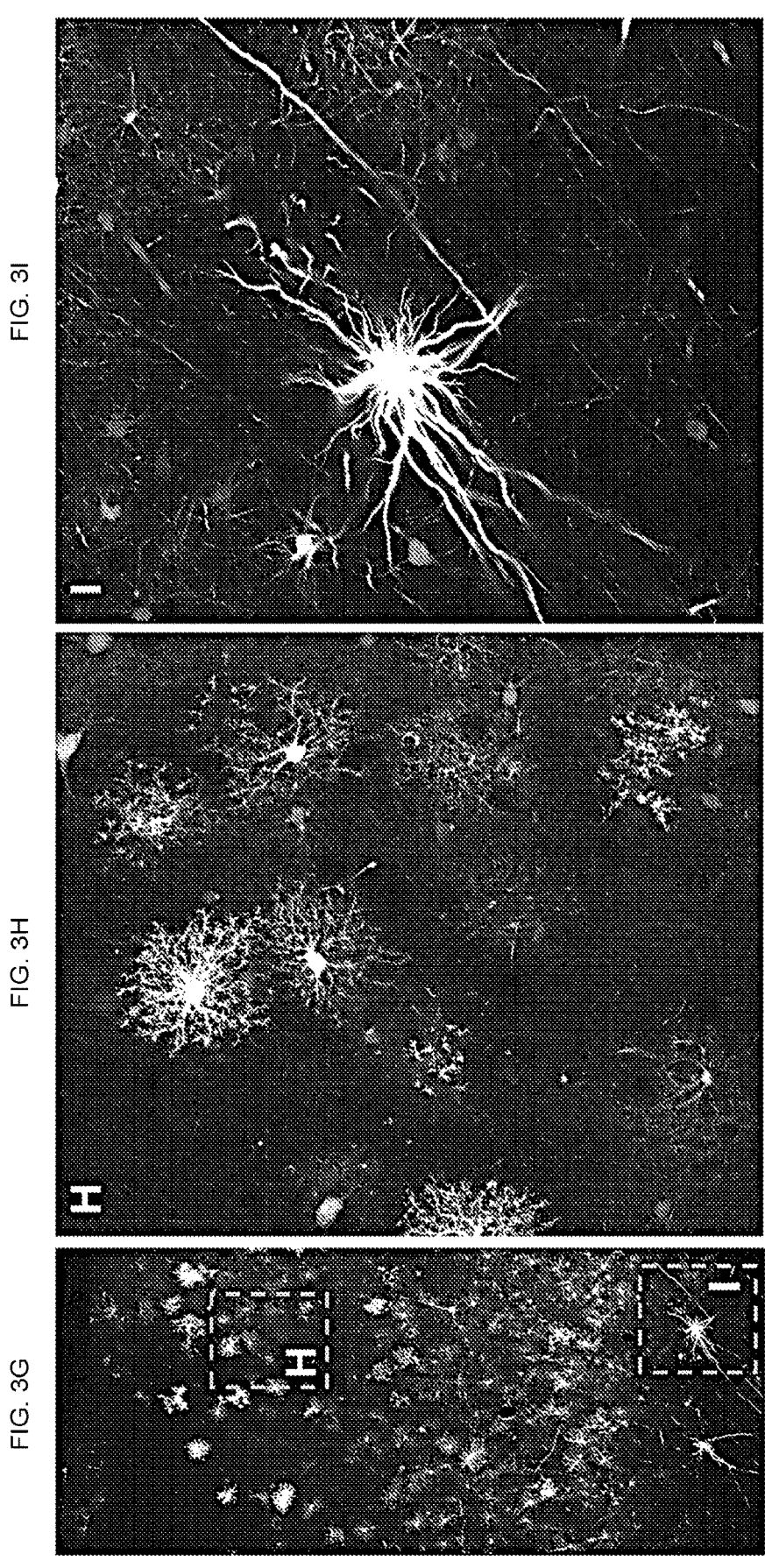

FIGS. 3G-3I: Native SYFP2 fluorescence after intraparenchymal injection of CN2089 packaged by PHP.eB into the cortex of a macaque non-human primate. Native SYFP2 alone in the full cortical column (3G), and examples of labeled protoplasmic (3H) and fibrous (3I) astrocytes. This data shows eHGT_390m enhancer driven reporter expression clearly marks neocortical astrocytes that exhibit diverse cellular morphologies.

Figure 3J:
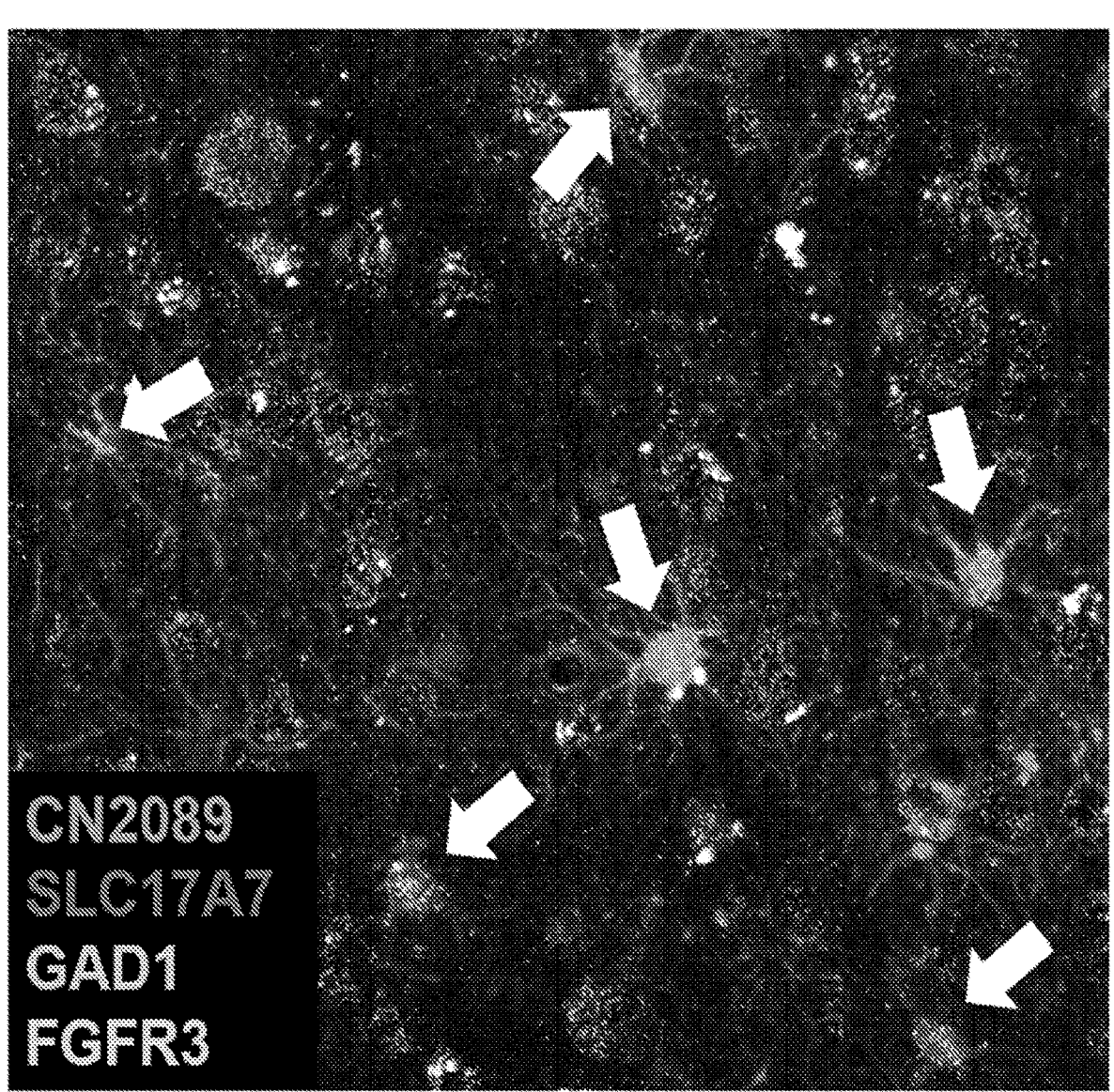
Figure 3K:
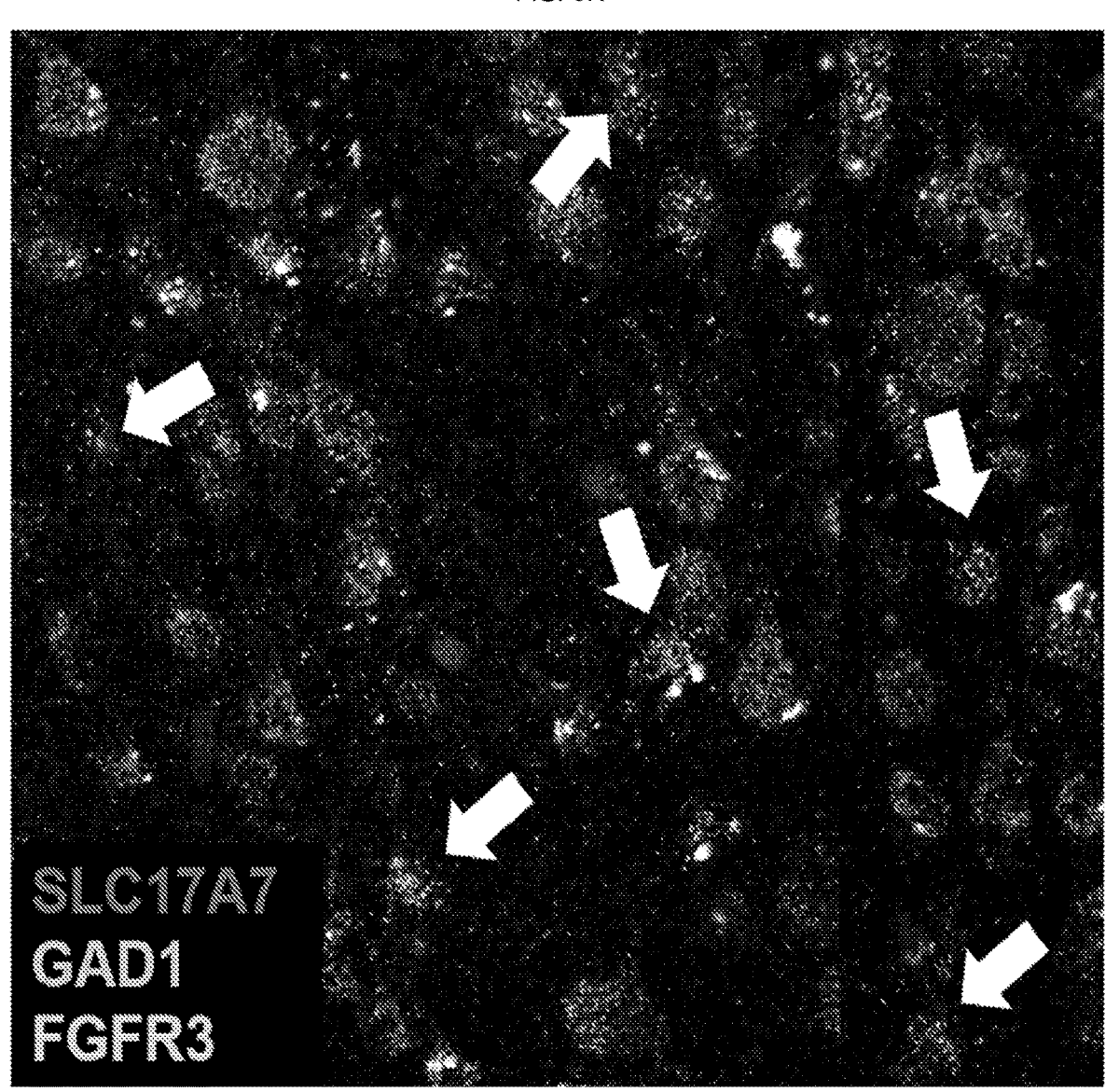

FIG. 3J, 3K: Molecular confirmation that SYFP2+ cells express astrocyte-selective but not neuronal-selective genes. Native SYFP2 fluorescence after intraparenchymal injection of CN2089 packaged by PHP.eB into the cortex of a macaque non-human primate. (3J) Native SYFP2 (green) with mFISH labeling of glutamatergic (SLC17A7-magenta), GABAergic (GAD1-cyan), and astrocyte (FGFR3-yellow) marker genes, or just the mFISH marker genes (3K). White arrows show SYFP2+ cells. Note SYFP2+ cells nearly always overlap with FGFR3, but not GAD1 or SLC17A7. This data shows eHGT_390m enhancer driven reporter expression occurs selectively in macaque astrocytes that express the marker gene FGFR3.

Figure 3L:
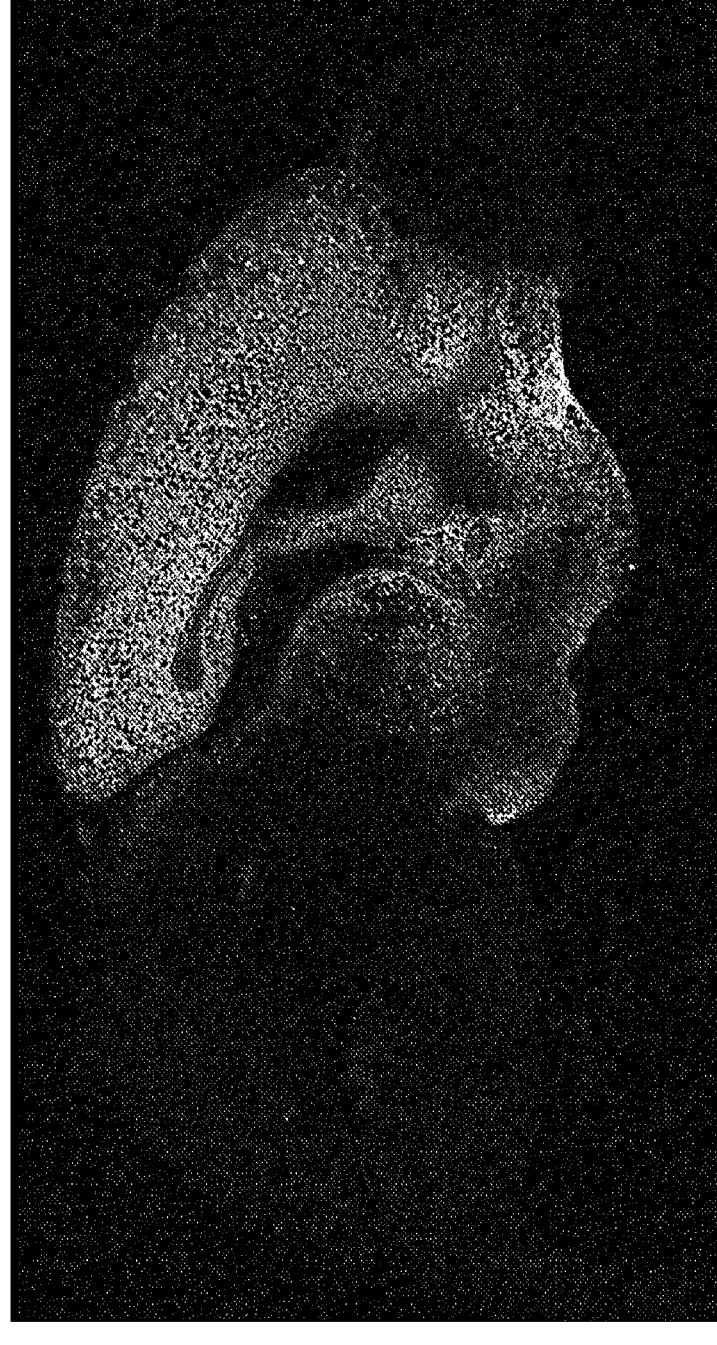
Figure 3M:
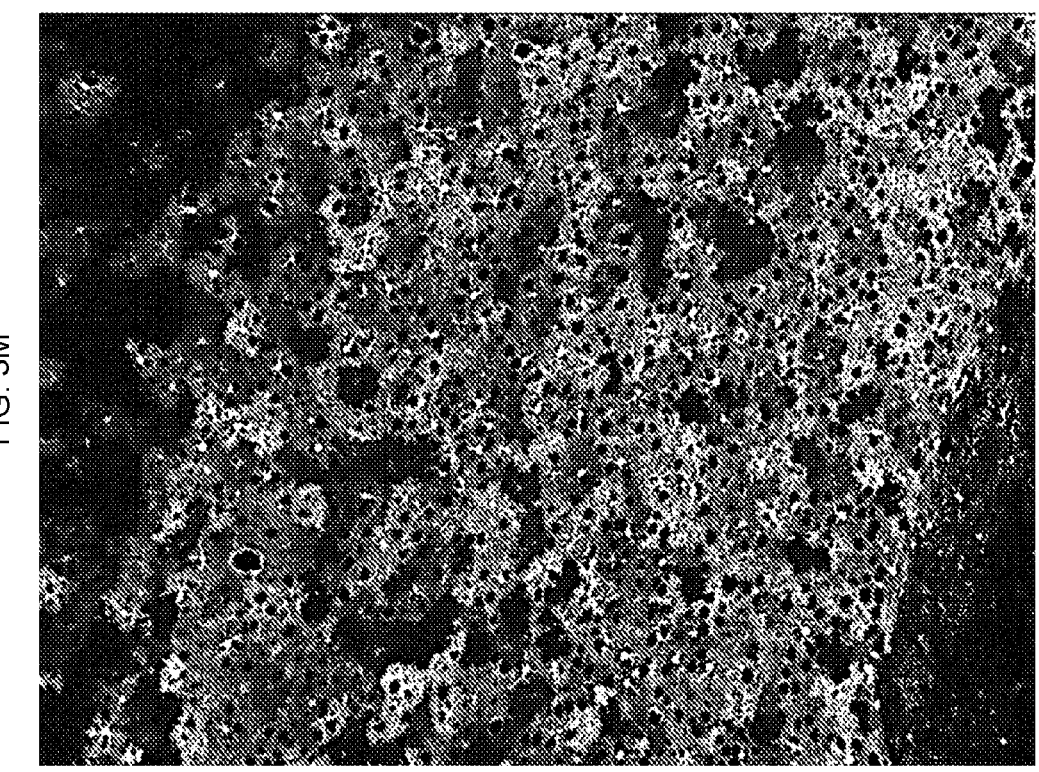

FIGS. 3L, 3M: SYFP2 fluorescence in P21 mice after ICV injection of CN2089 packaged with PHP.eB capsid in P2 mice. Whole brain sagittal section (L) and visual cortex (M) shows strong expression in cell with astrocyte morphology in the brain. This shows that with neonatal ICV injection of CN2089, particularly strong expression is seen in the forebrain structures.

Figure 4A:
Figure 4B:

FIGS. 4A, 4B: Native SYFP2 fluorescence montage of a sagittal section of a whole mouse brain (4A) and visual cortex (4B) showing selective expression of SYFP2 in cells with oligodendrocyte morphology after retro-orbital injection of CN2109 virus packaged with the PHP.eB capsid. This data shows that the eHGT_410m enhancer drives reporter expression selectively in mouse oligodendrocytes.

Figure 4C:
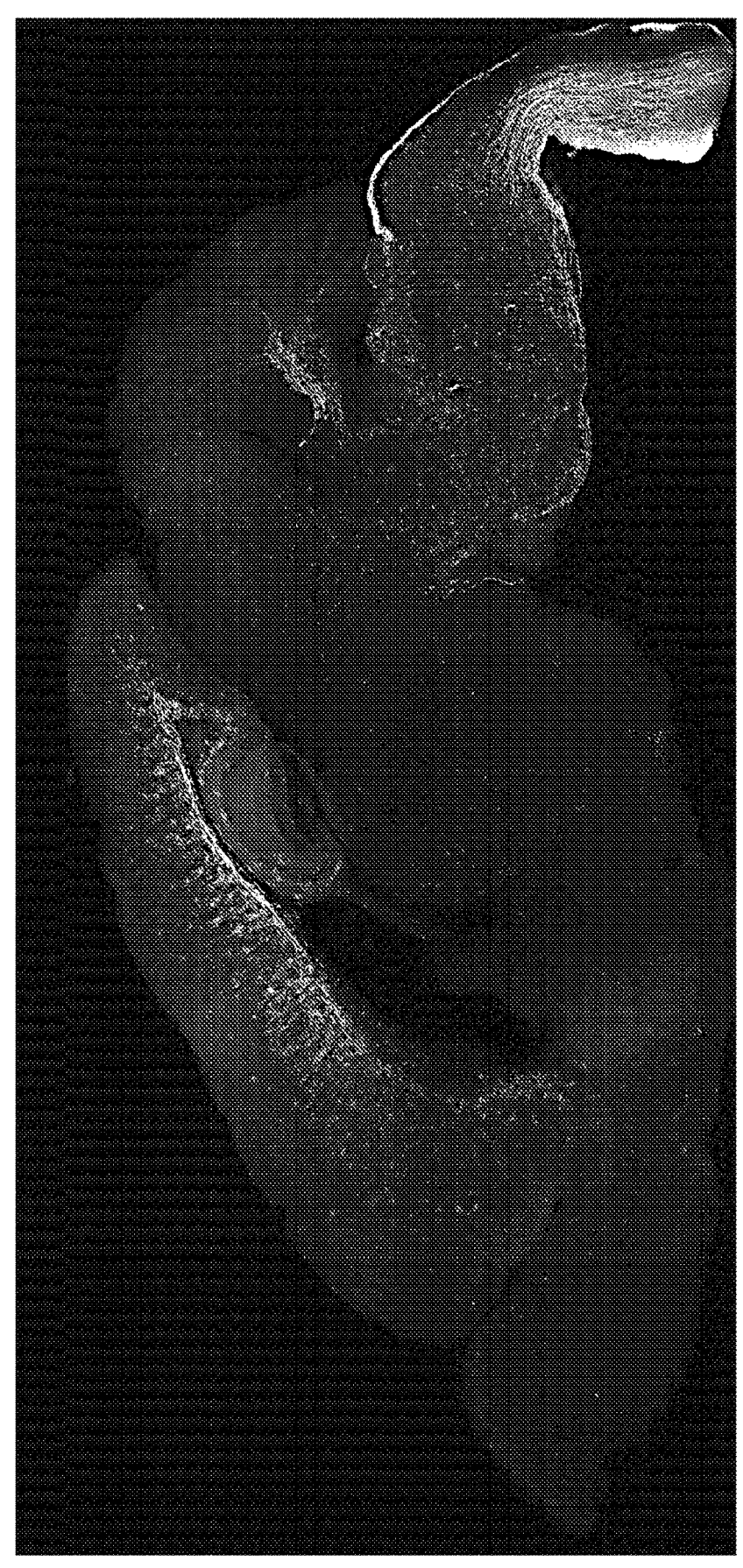
Figure 4D:
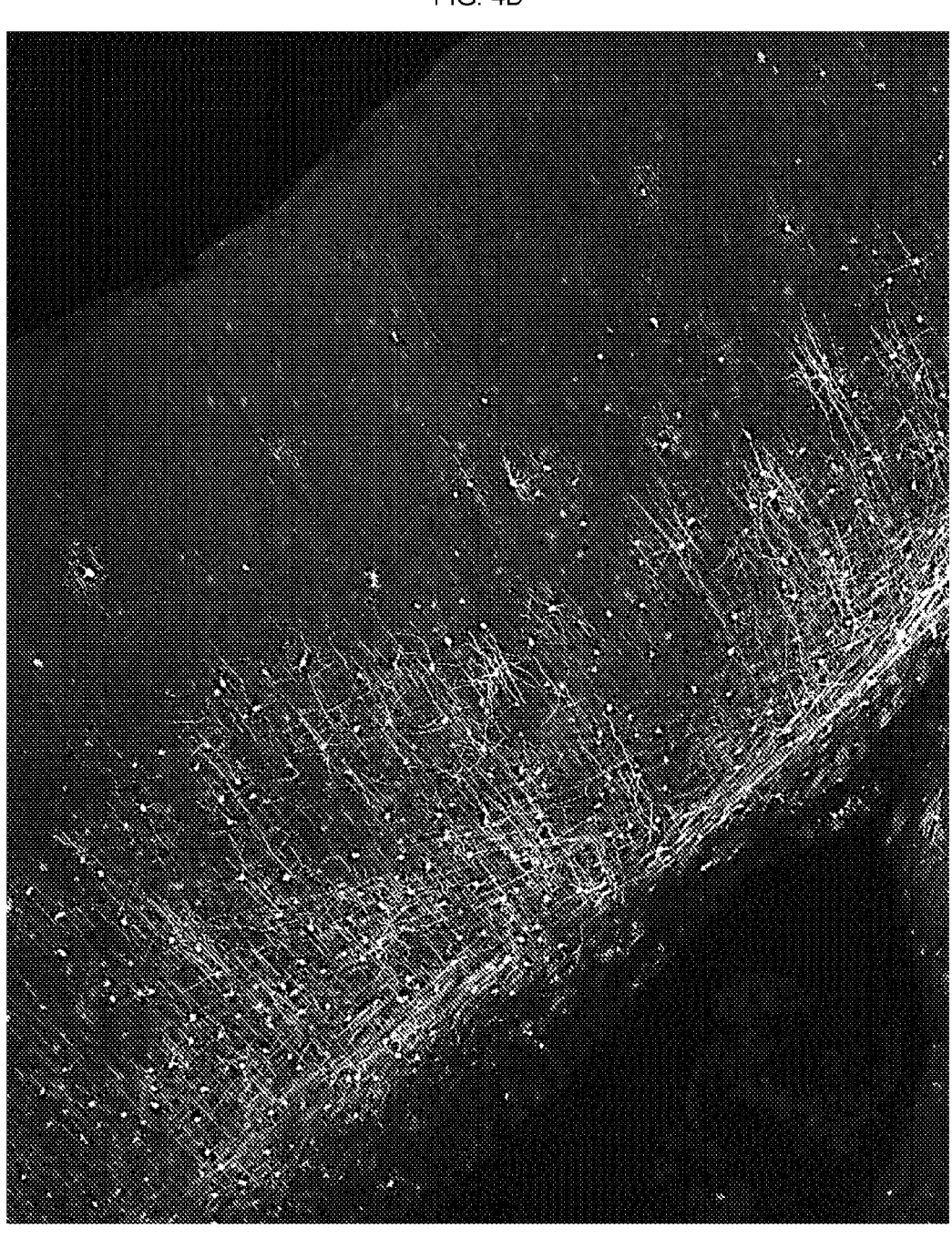

FIGS. 4C, 4D: SYFP2 fluorescence in P21 mice after ICV injection of CN2109 packaged with PHP.eB capsid in P2 mice. Whole brain sagittal section (4C) and cortex (4D) shows strong expression in cell with oligodendrocyte morphology in the brain. Particularly strong expression is seen in the spinal cord. This data shows that the eHGT_410m enhancer drives reporter expression selectively in mouse oligodendrocytes after neonatal delivery of CN2109 ICV.

Figure 4E:
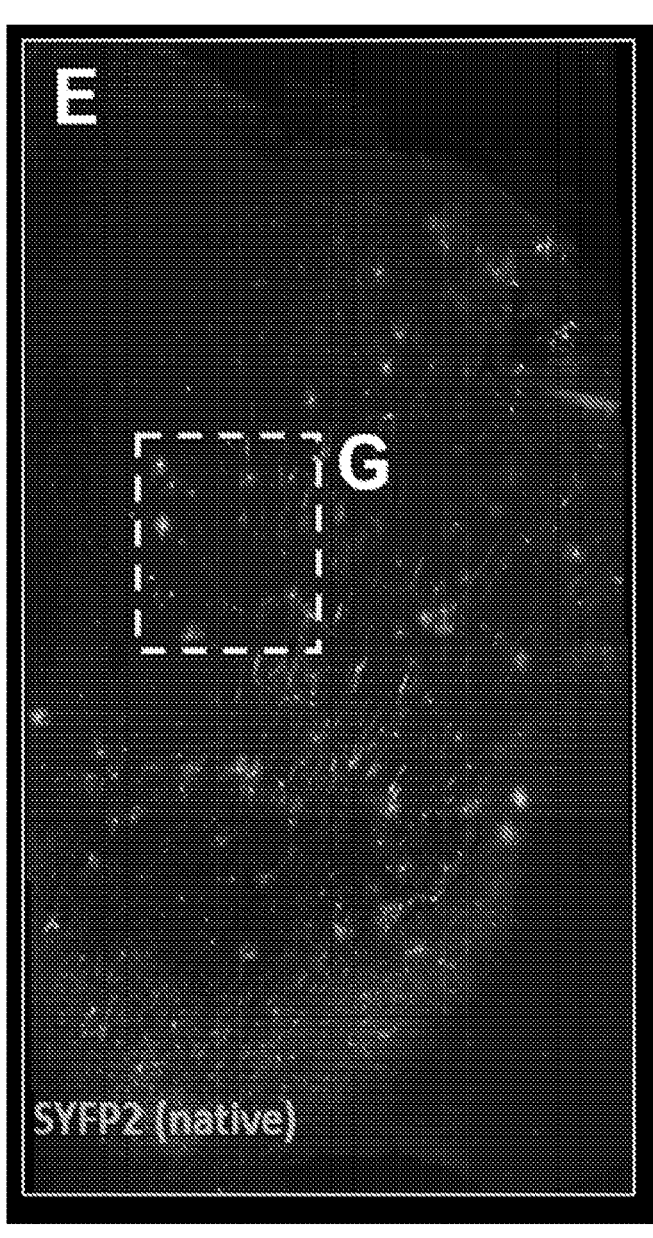
Figure 4F:
Figure 4G:
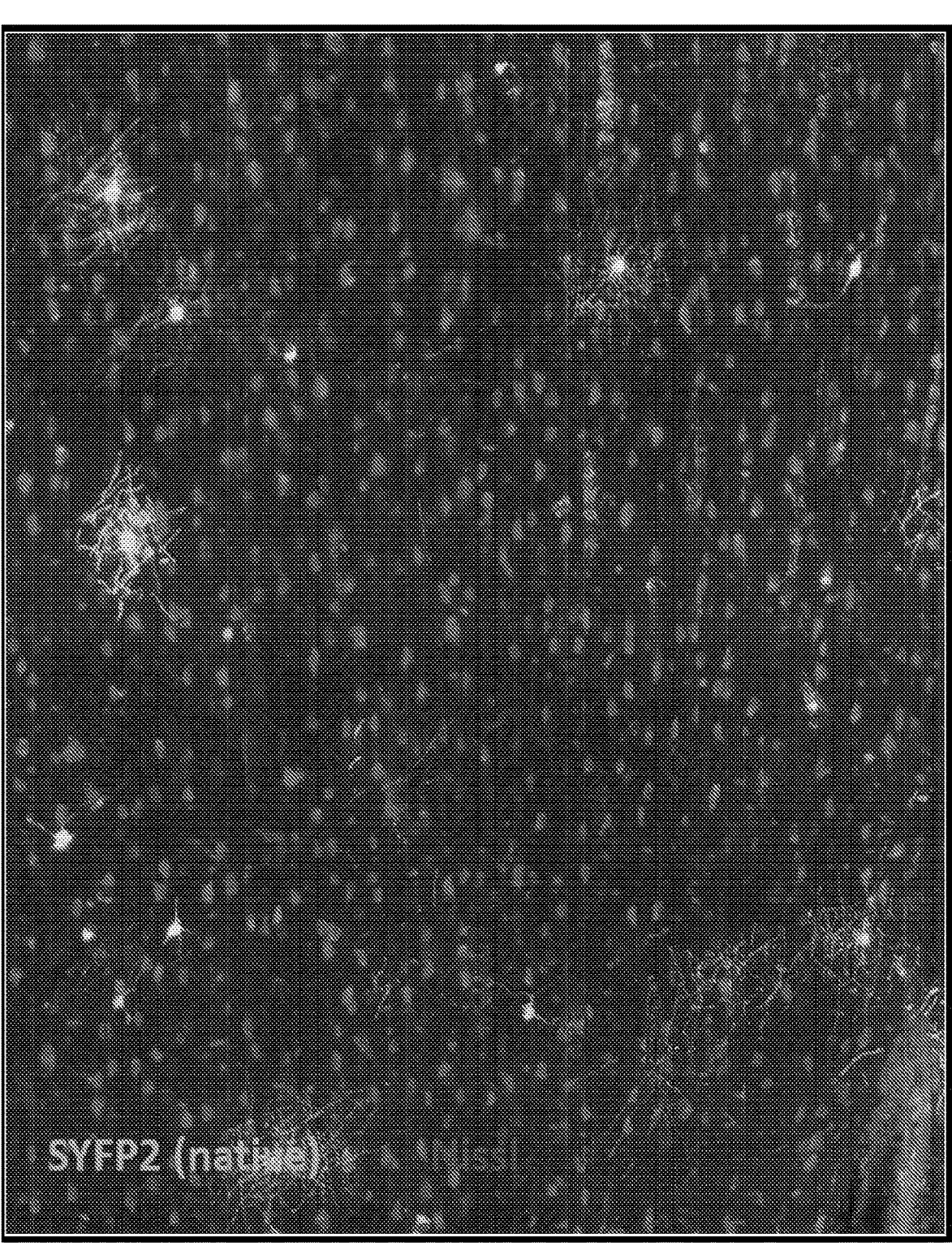

FIGS. 4E-4G: Native SYFP2 fluorescence after intraparenchymal injection of CN2109 packaged by PHP.eB into the cortex of a macaque non-human primate. Native SYFP2 alone (E) and co-stained with DAPI and propidium iodide (4F) is shown. (4G) Higher resolution of inset in (4E) showing SYFP2 and Nissl. Note most cells display a pronounced oligodendrocyte morphology. This data shows that the eHGT_410m enhancer drives reporter expression selectively in macaque cells that display oligodendrocyte morphology.

Figure 4H:
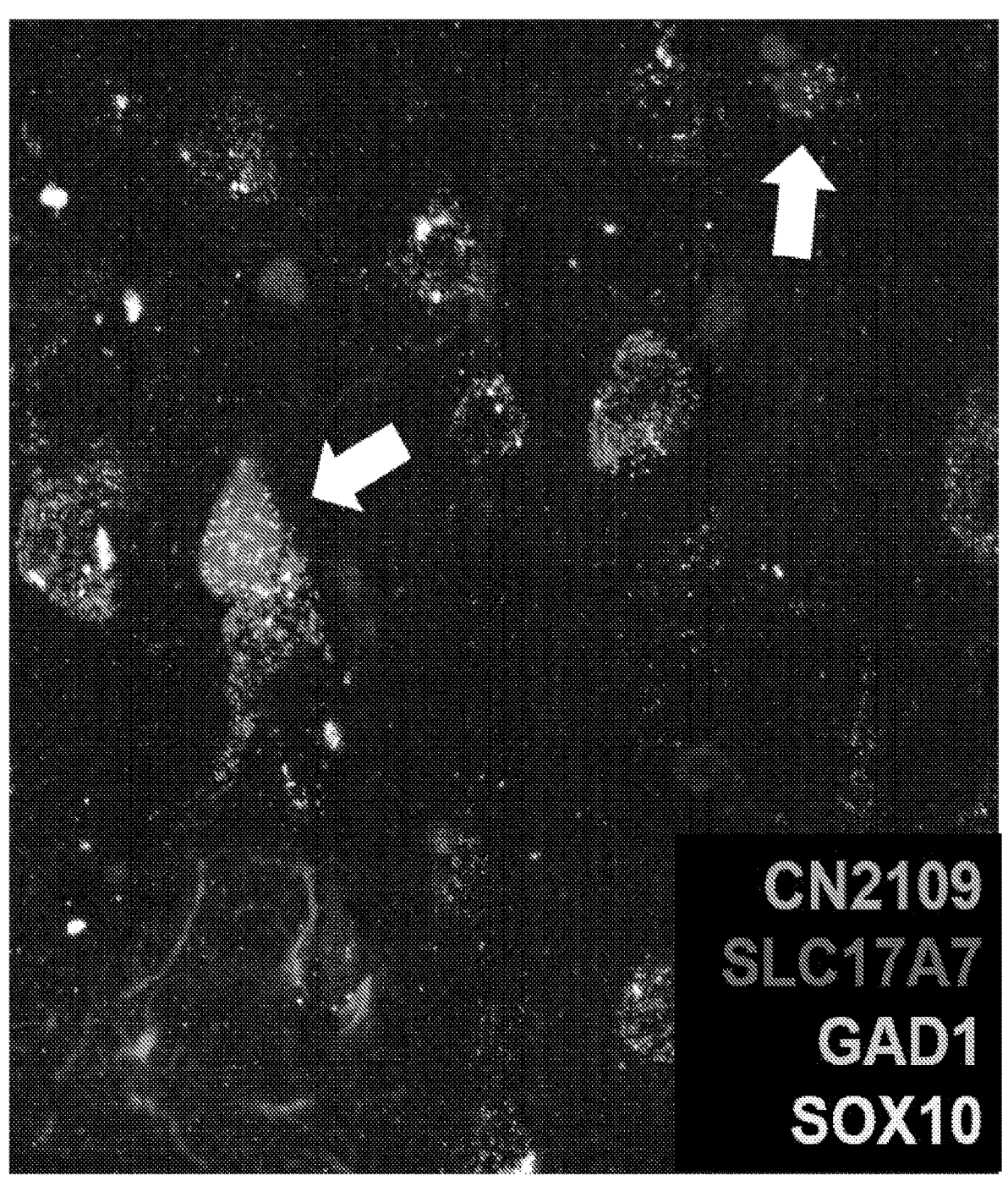
Figure 4I:
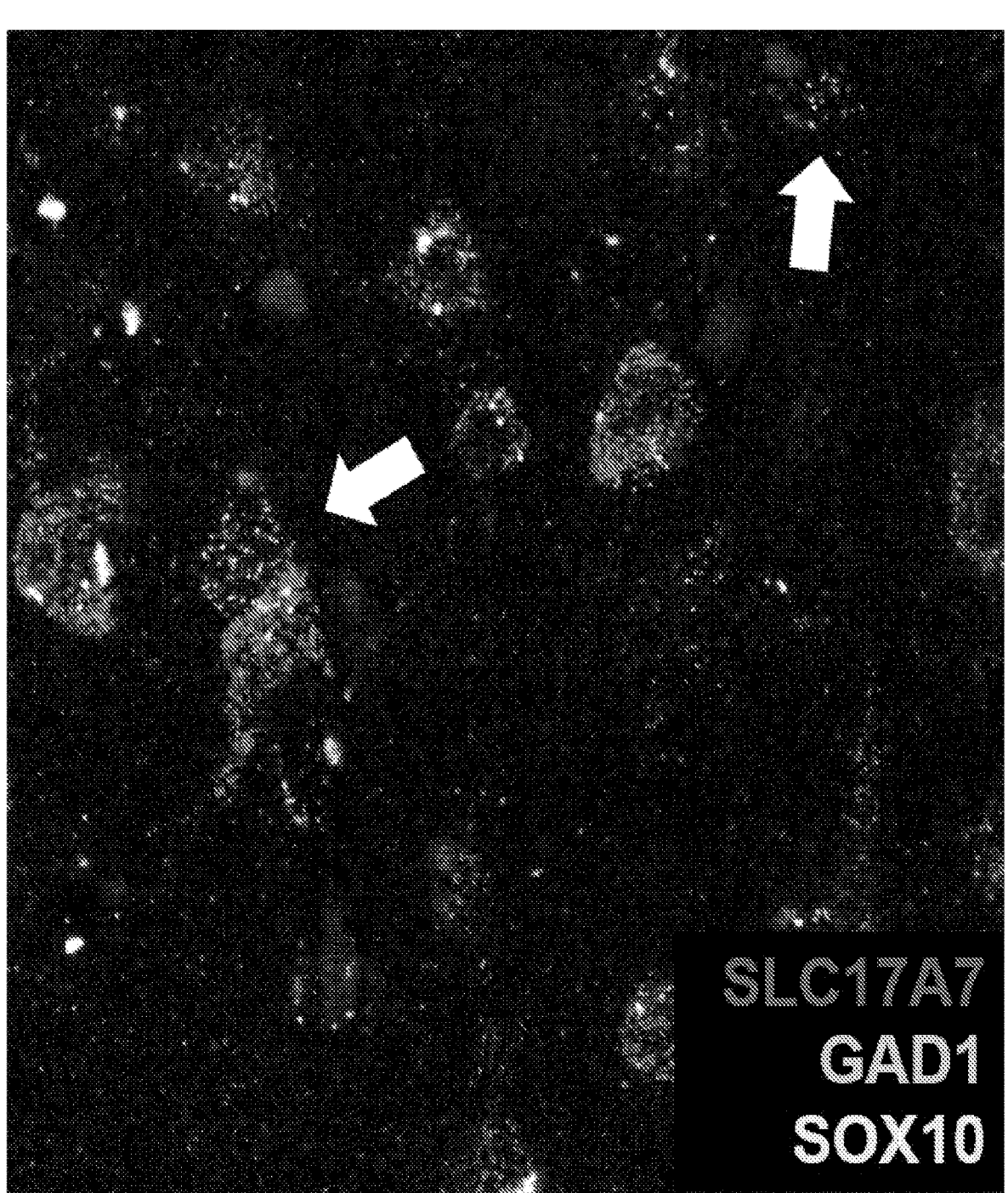

FIGS. 4H, 4I: Molecular confirmation that SYFP2+ cells express oligodendrocyte-selective but not neuronal-selective genes. Native SYFP2 fluorescence after intraparenchymal injection of CN2109 packaged by PHP.eB into the cortex of a macaque non-human primate. (4H) Native SYFP2 (green) with mFISH labeling of glutamatergic (SLC17A7—magenta), GABAergic (GAD1-cyan), and oligodendrocyte (SOX10—yellow) marker genes, or just the mFISH marker genes (4K). White arrows show SYFP2+ cells. Note SYFP2+ cells nearly always overlap with SOX10, but not GAD1 or SLC17A7. This shows that the eHGT_410m enhancer drives reporter expression selectively in macaque neocortical cells that display oligodendrocyte-selective marker gene SOX10.

Figure 4J:
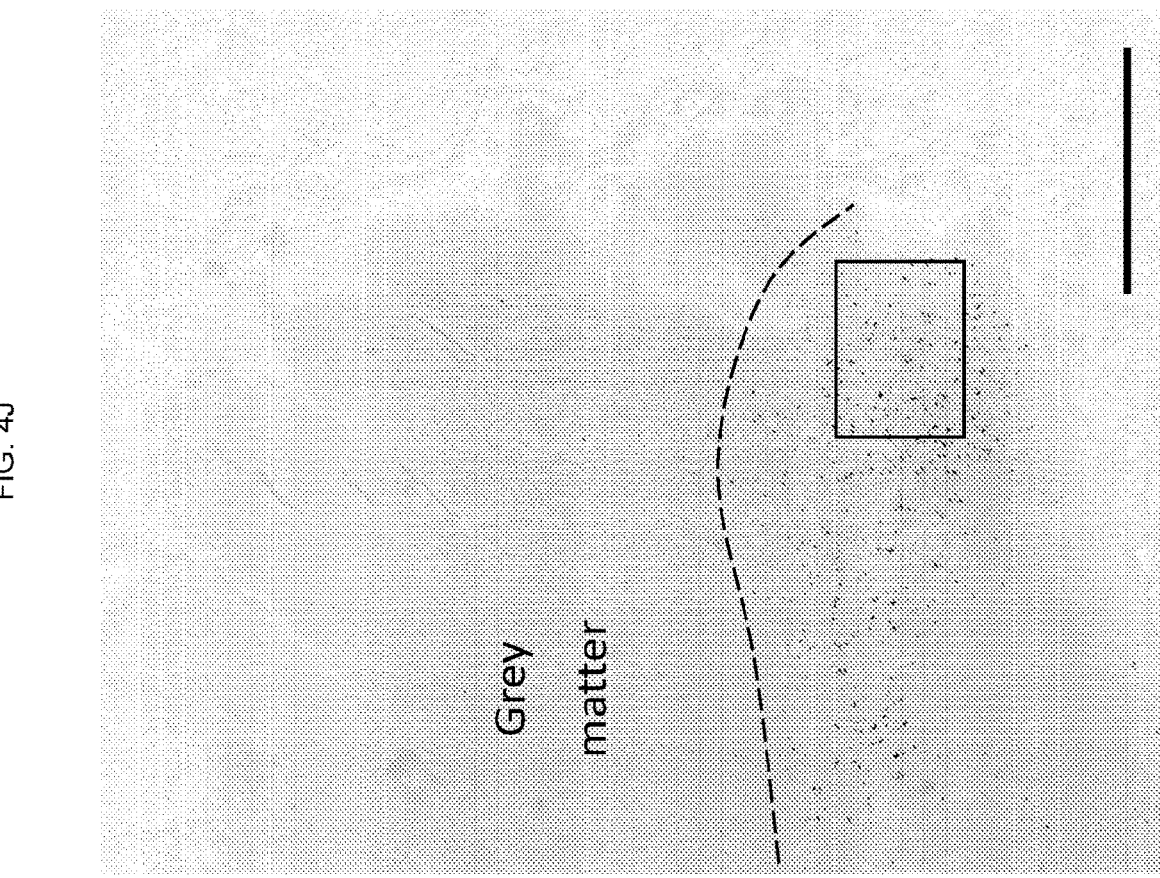
Figure 4K:
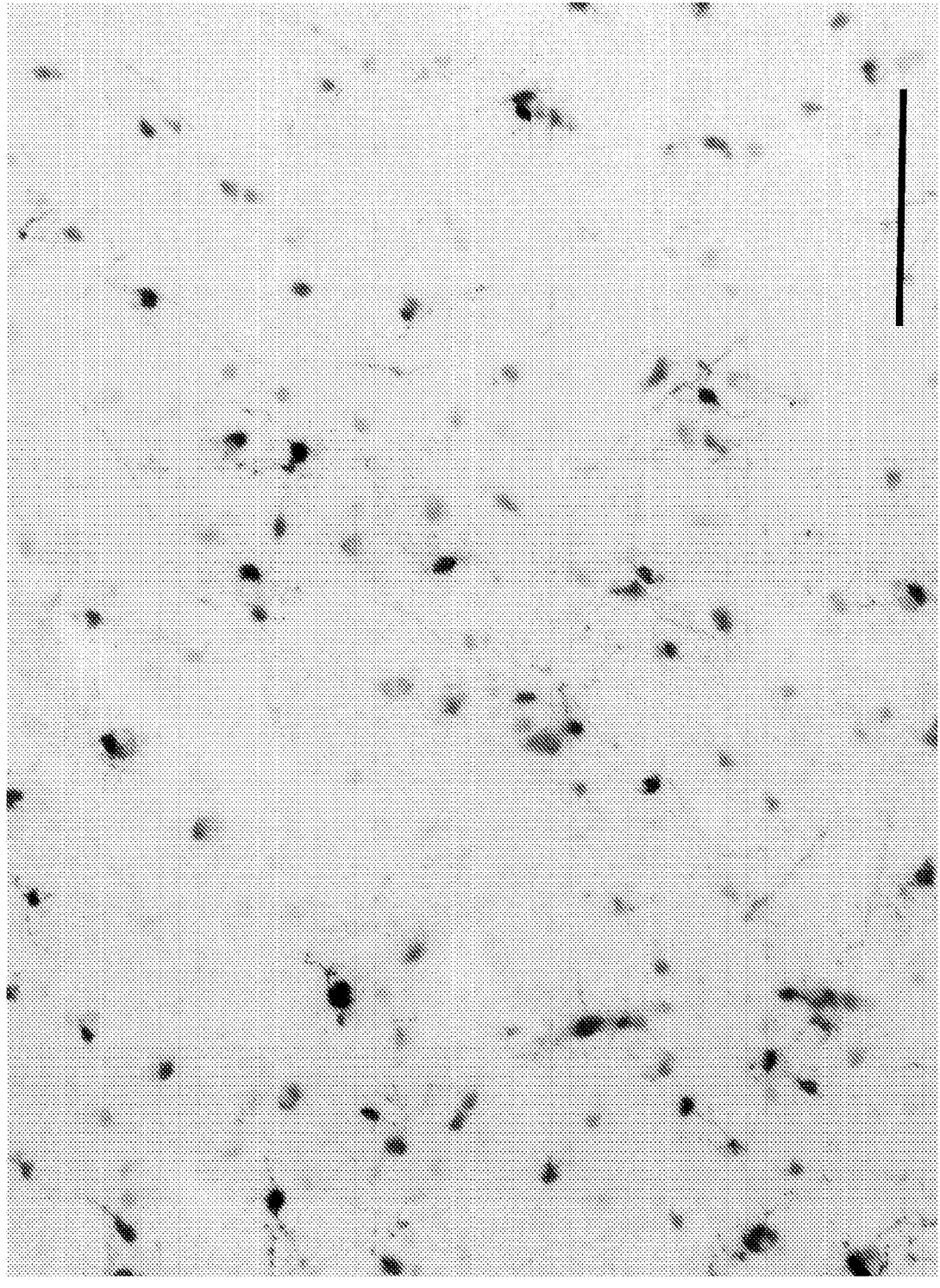

FIGS. 4J, 4K. Oligodendrocyte targeting enhancer AAV vector CN2109 (enhancer: eHGT_410m) drives SYFP2 reporter expression in human neocortical oligodendrocytes enriched in the white matter. (4J) Fluorescent reporter expression in a human rapid autopsy neocortical slice culture at 5 days in vitro and 5 days post infection with AAV vector CN2109 serotype PHPeB. The postmortem interval was 10 hours prior to tissue culture. Scale bar: 1 mm. (4K) Higher magnification view of the boxed region from (4J) showing native SYFP2 signal in cells with oligodendrocyte morphology in the white matter (below the dotted line in (4J)). Scale bar: 200 microns. This demonstration of oligodendrocyte labeling in human postmortem slice culture is a powerful demonstration of targeting non-neuronal cell types in human/primate brain.

Figure 5A:
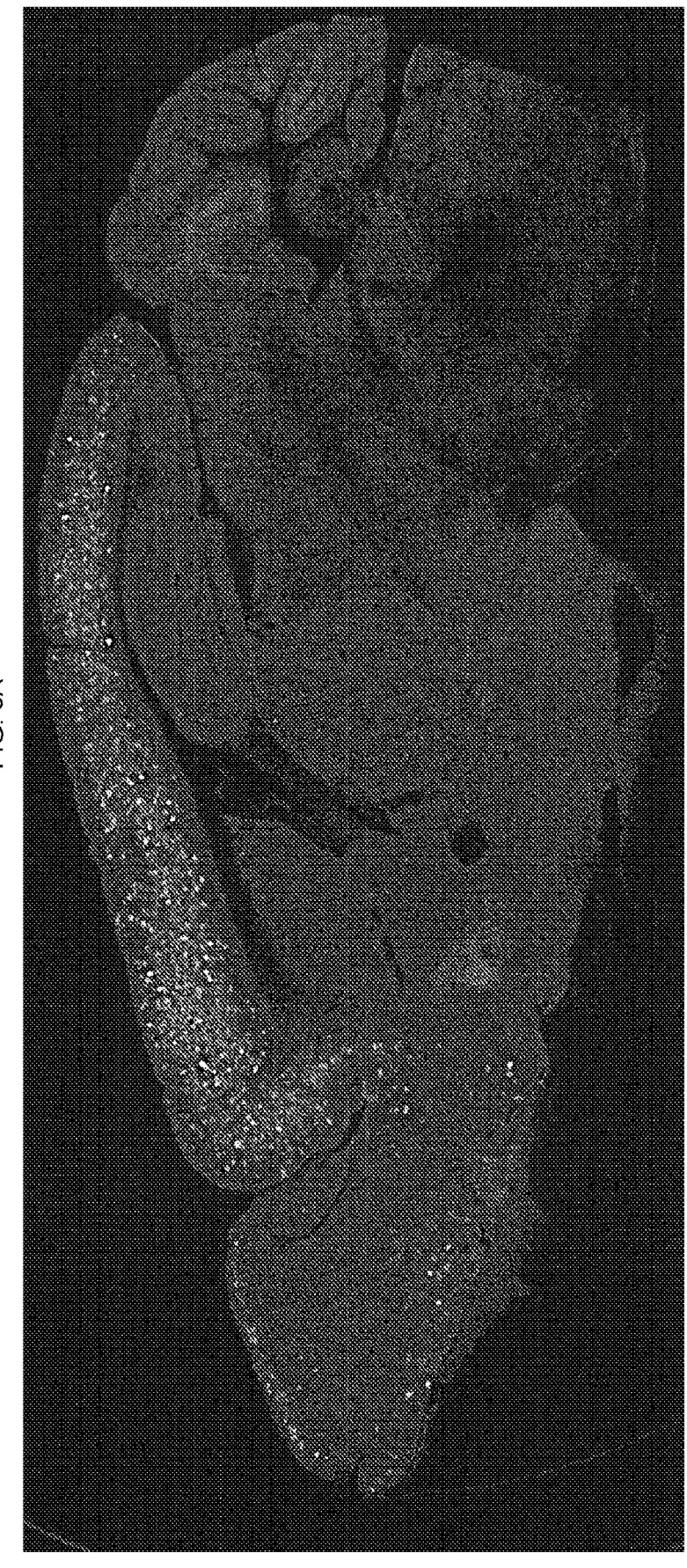
Figure 5B:
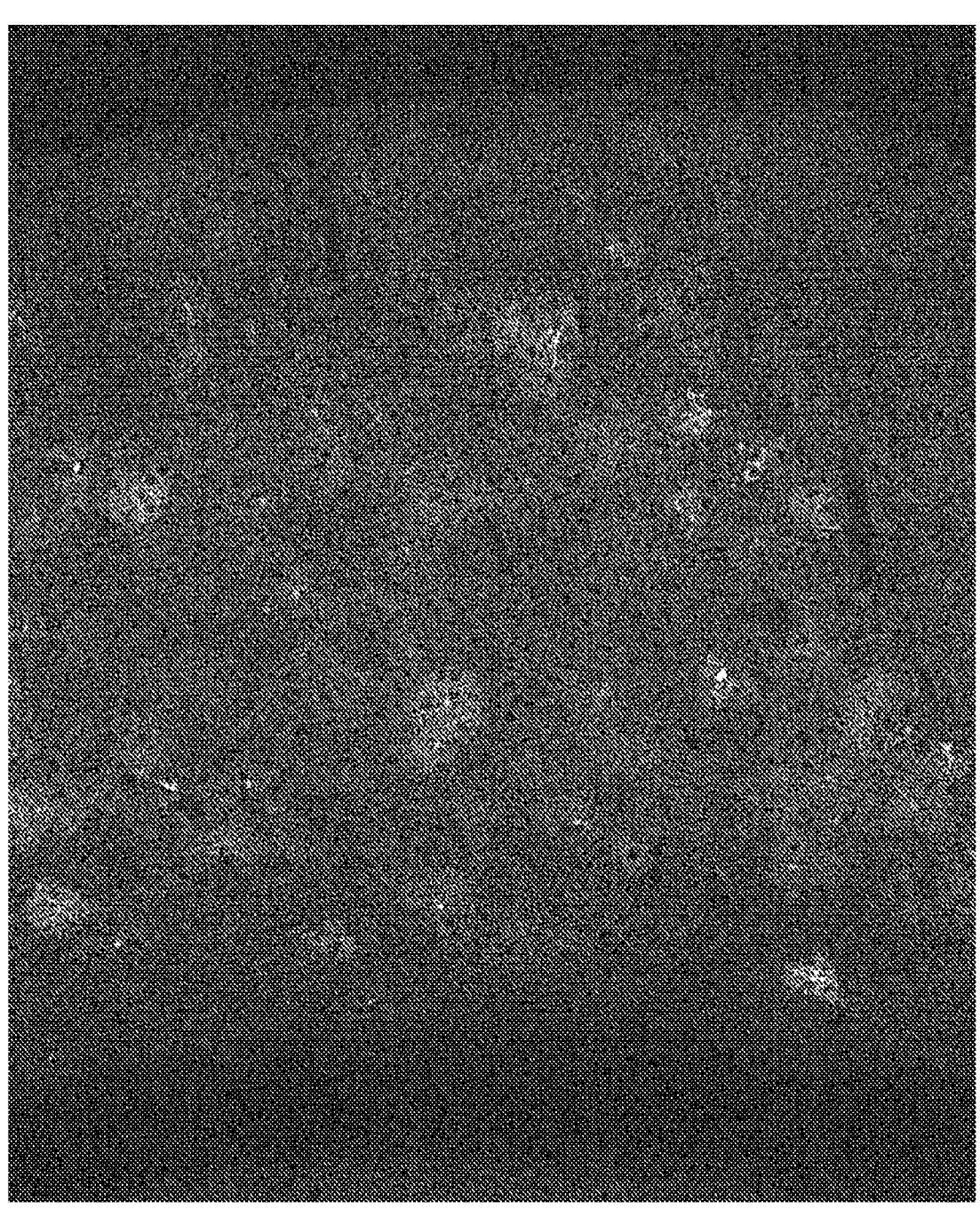

FIGS. 5A, 5B: Native SYFP2 fluorescence montage of a sagittal section of a whole mouse brain (5A) and visual cortex (5B) showing selective expression of SYFP2 in cells with astrocyte morphology after retro-orbital injection of CN2153 virus packaged with the PHP.eB capsid. This data shows that the eHGT_390h enhancer drives reporter expression selectively in mouse cells with astrocyte morphology.

Figure 6A:
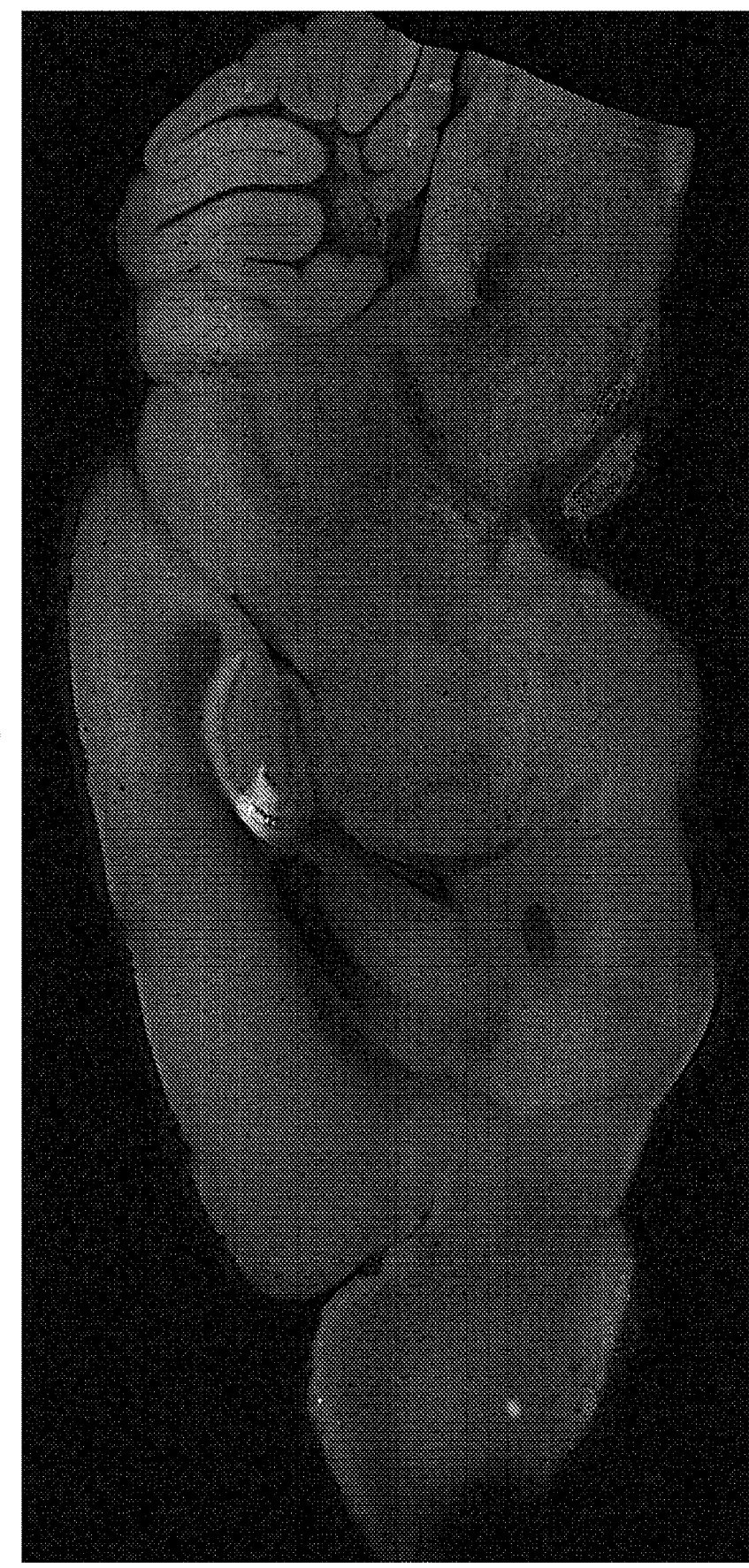
Figure 6B:
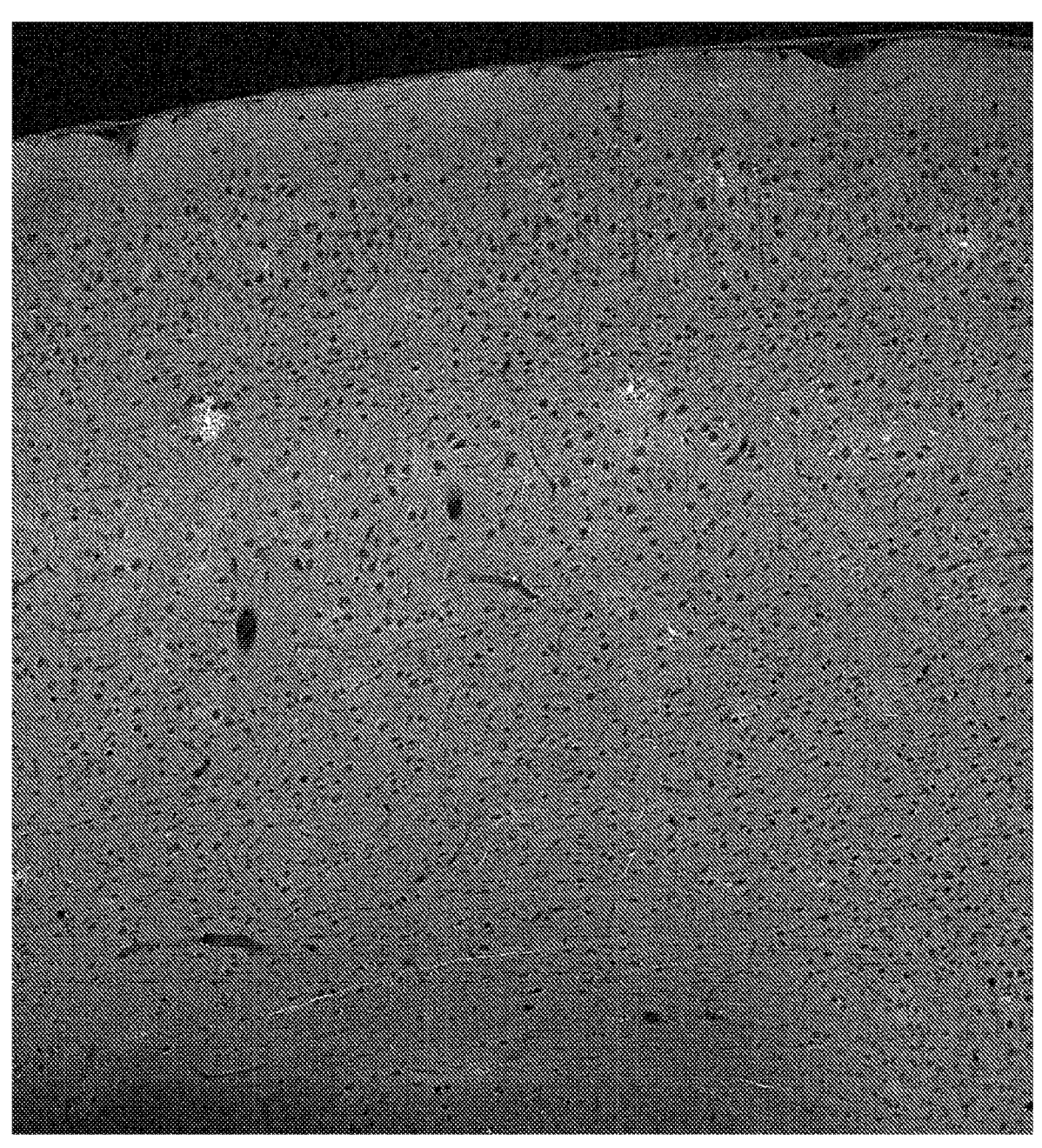

FIGS. 6A, 6B: Native SYFP2 fluorescence montage of a sagittal section of a whole mouse brain (A) and visual cortex (B) showing dim but selective expression of SYFP2 in cells with astrocyte morphology after retro-orbital injection of CN2145 virus packaged with the PHP.eB capsid. This data shows that the eHGT_377h enhancer drives reporter expression selectively in mouse cells with astrocyte morphology.

Figure 7A:
Figure 7B:
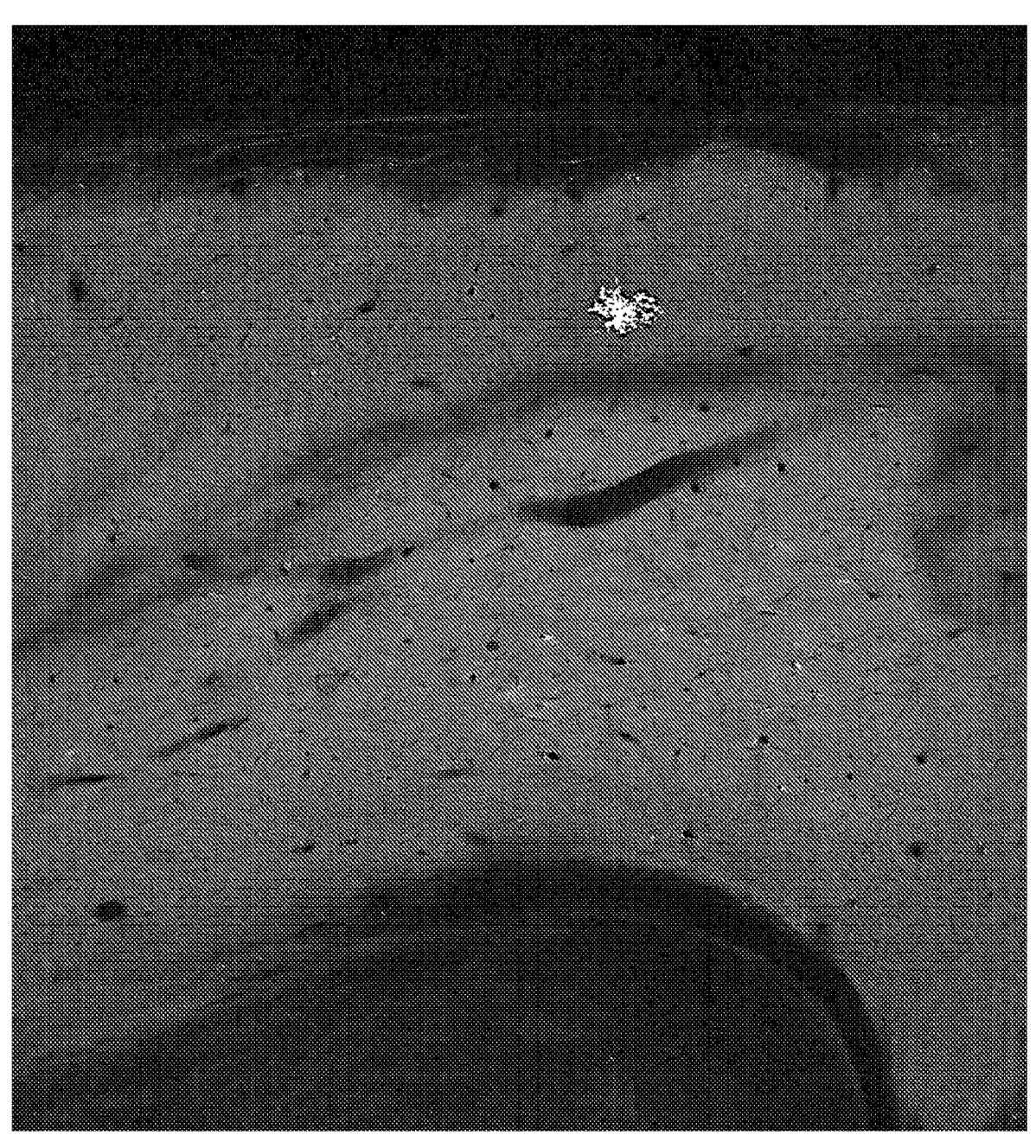

FIGS. 7A, 7B: Native SYFP2 fluorescence montage of a sagittal section of a whole mouse brain (7A) and visual cortex (7B) showing selective expression of SYFP2 in cells with astrocyte morphology after retro-orbital injection of CN2144 virus packaged with the PHP.eB capsid. This data shows that the eHGT_376h enhancer drives reporter expression selectively in mouse cells with astrocyte morphology.

Figure 8A:
Figure 8B:
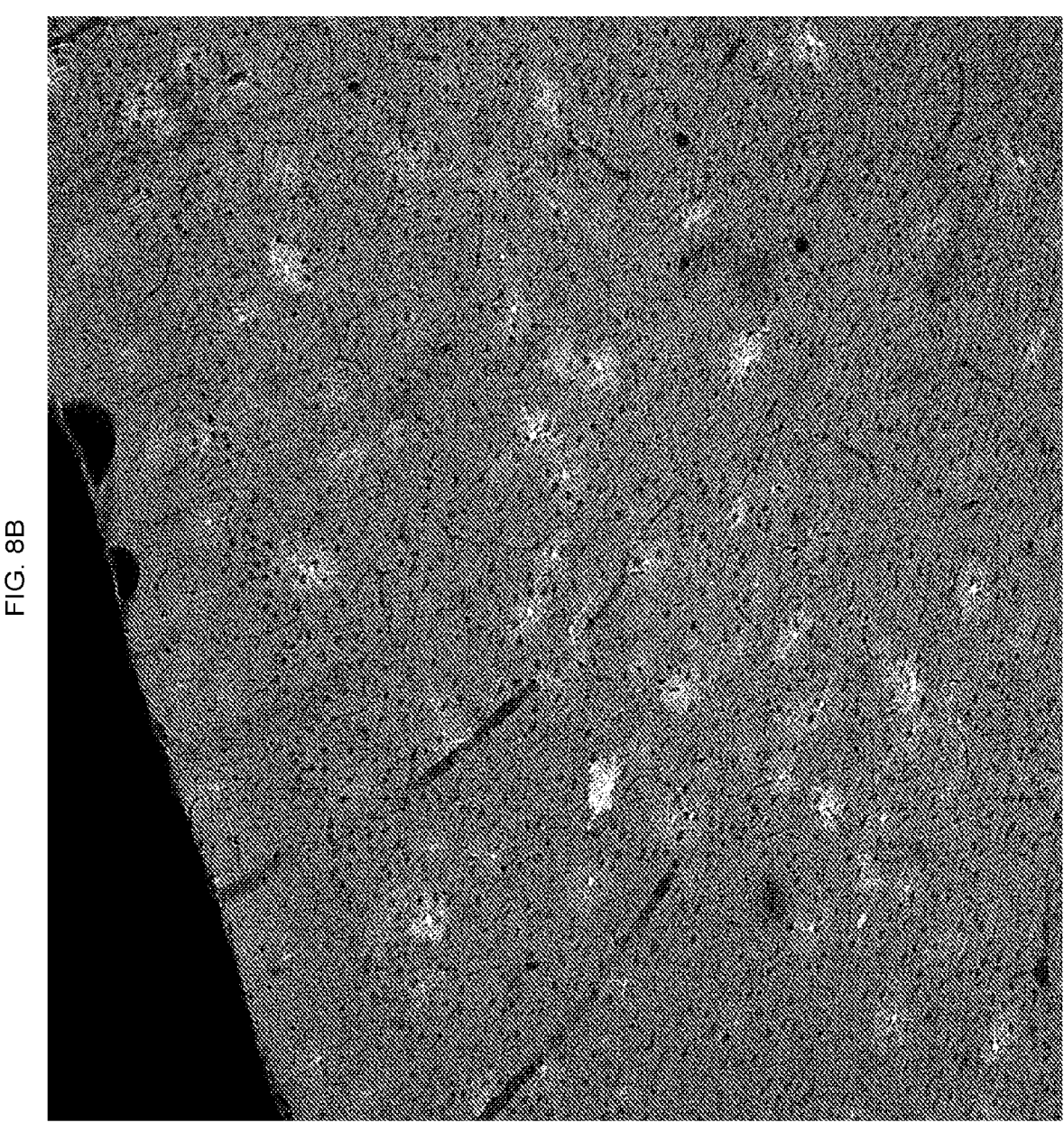

FIGS. 8A, 8B: Native SYFP2 fluorescence montage of a sagittal section of a whole mouse brain (8A) and visual cortex (8B) showing dim but selective expression of SYFP2 in cells with astrocyte morphology after retro-orbital injection of CN2147 virus packaged with the PHP.eB capsid. This data shows that the eHGT_382h enhancer drives reporter expression selectively in mouse cells with astrocyte morphology.

Figure 9A:
Figure 9B:
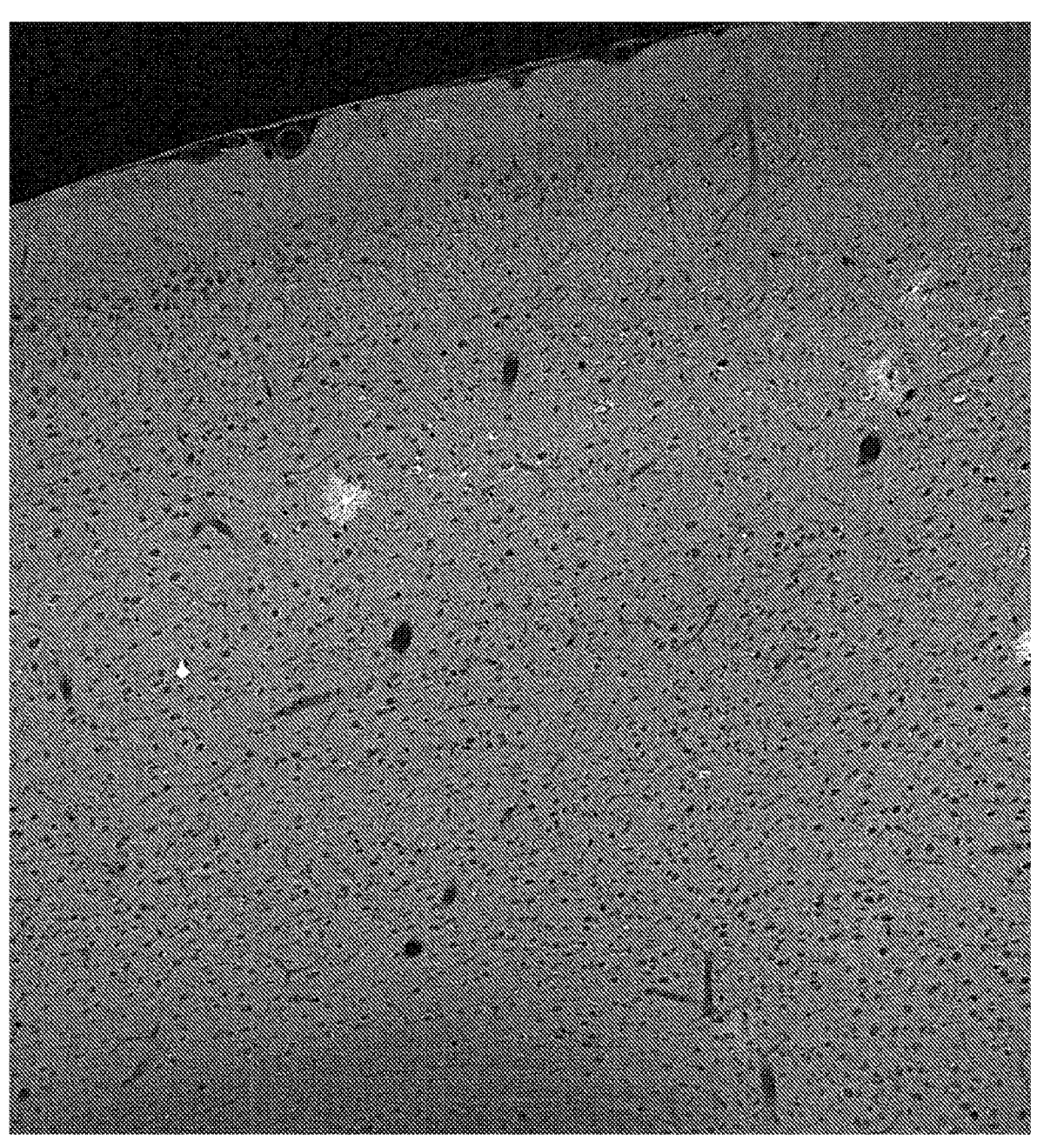

FIGS. 9A, 9B: Native SYFP2 fluorescence montage of a sagittal section of a whole mouse brain (9A) and visual cortex (9B) showing selective expression of SYFP2 in cells with astrocyte morphology after retro-orbital injection of CN2084 virus packaged with the PHP.eB capsid. This data shows that the eHGT_373m enhancer drives reporter expression selectively in mouse cells with astrocyte morphology.

Figure 10A:
Figure 10B:
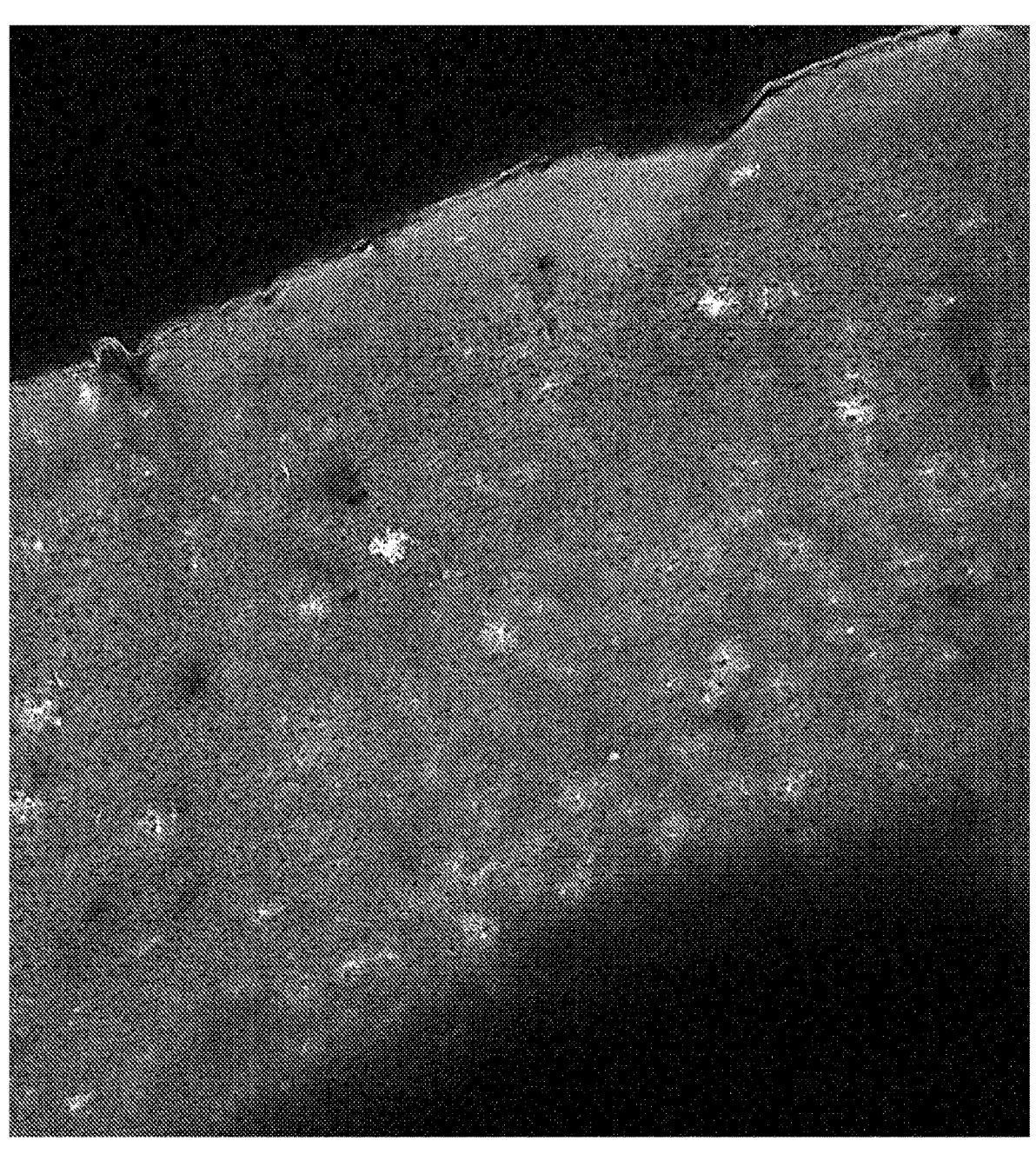

FIGS. 10A, 10B: Native SYFP2 fluorescence montage of a sagittal section of a whole mouse brain (10A) and visual cortex (10B) showing selective expression of SYFP2 in cells with astrocyte morphology after retro-orbital injection of CN2088 virus packaged with the PHP.eB capsid. This data shows that the eHGT_386m enhancer drives reporter expression selectively in mouse cells with astrocyte morphology.

Figure 11A:
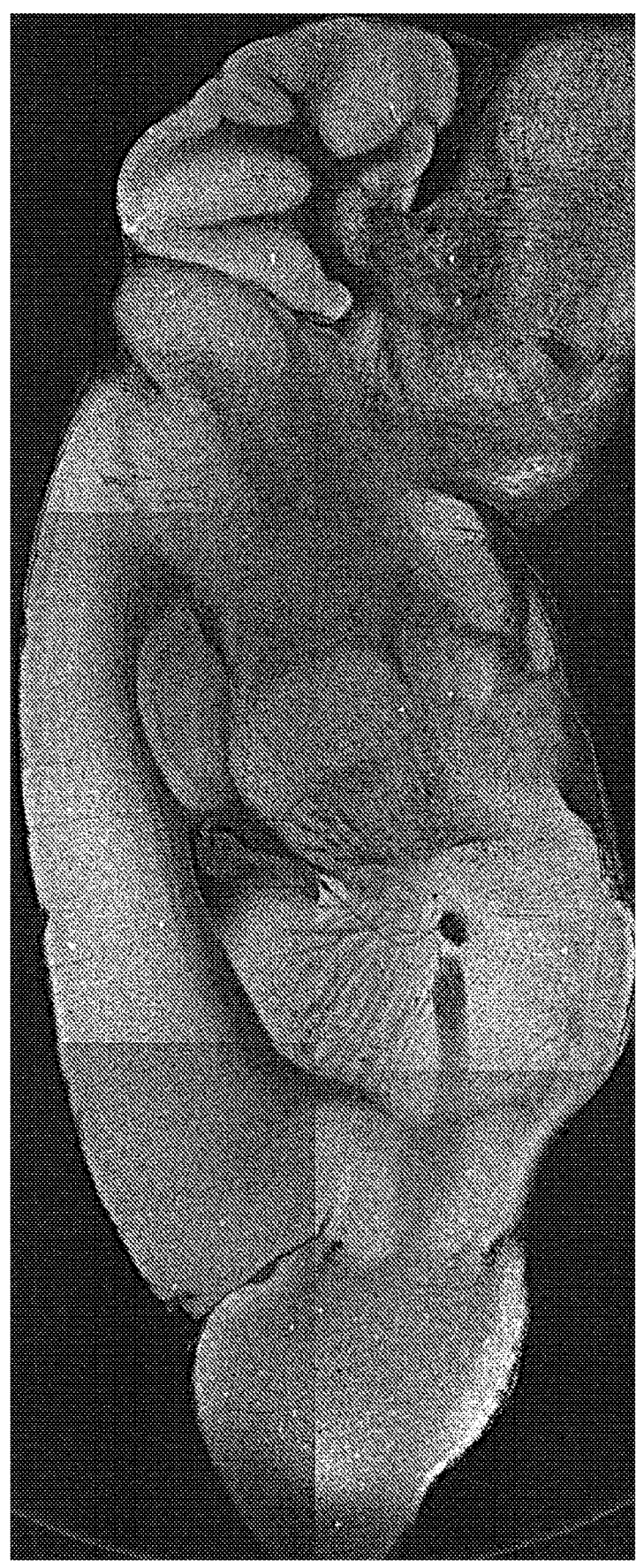
Figure 11B:
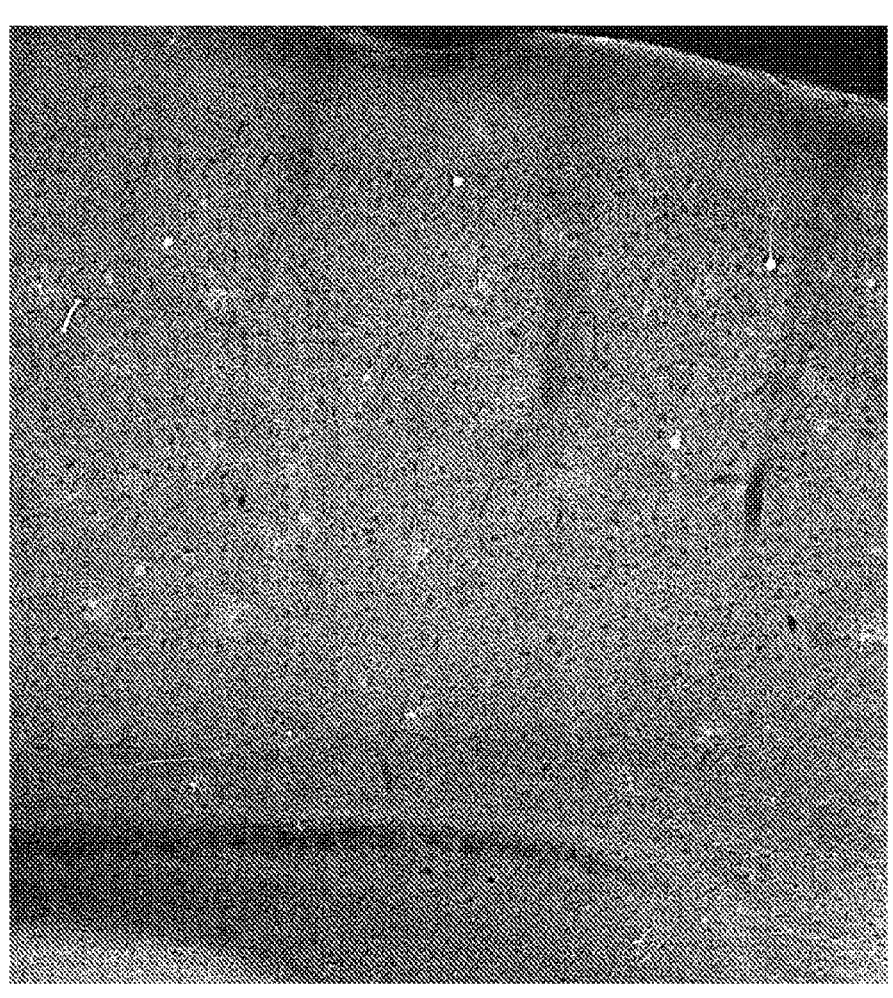

FIGS. 11A, 11B: Native SYFP2 fluorescence montage of a sagittal section of a whole mouse brain (11A) and visual cortex (11B) showing dim but selective expression of SYFP2 in cells with astrocyte morphology after retro-orbital injection of CN2097 virus packaged with the PHP.eB capsid. This data shows that the eHGT_383m enhancer drives reporter expression selectively in mouse cells with astrocyte morphology.

Figure 12A:
Figure 12B:
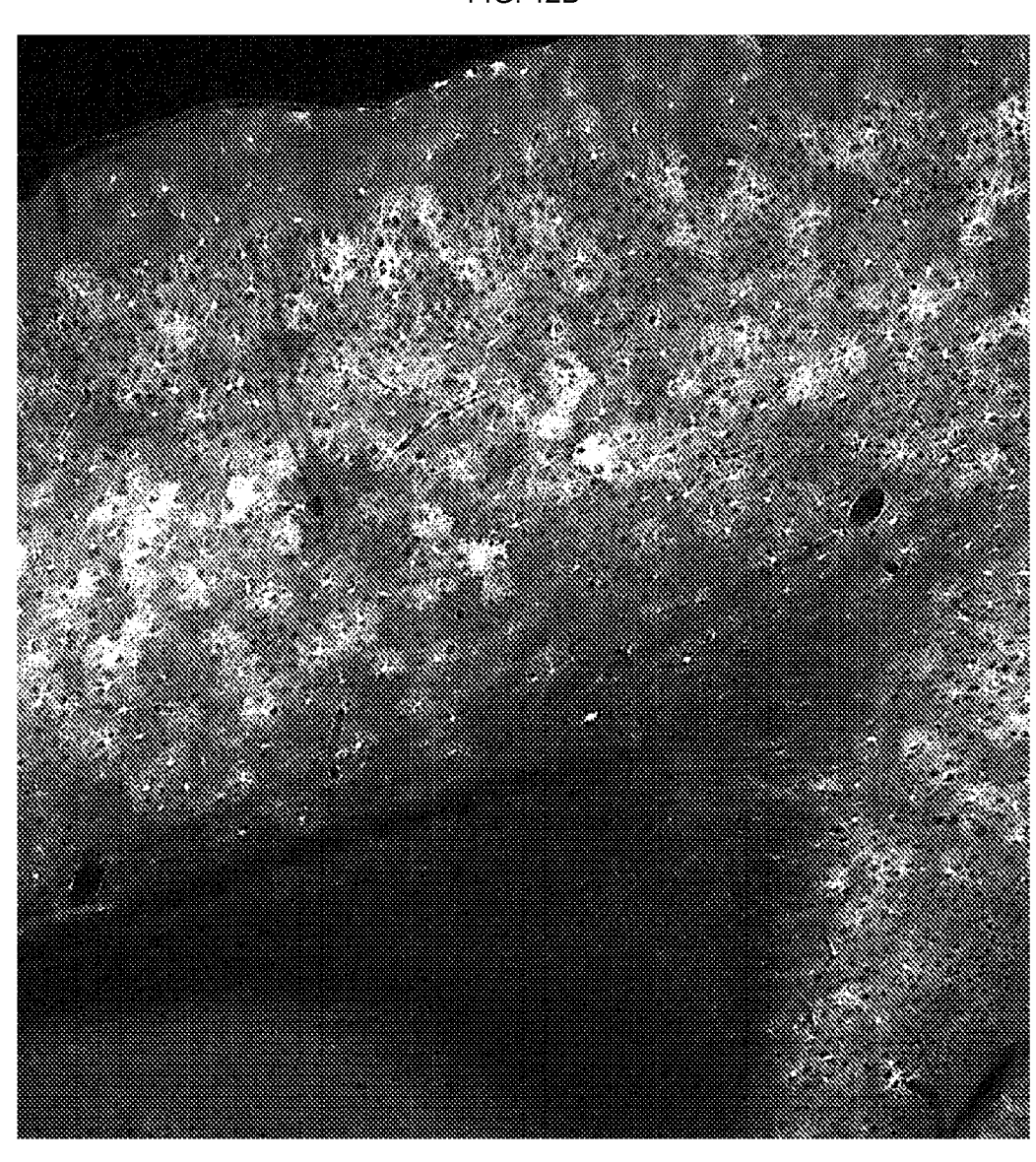
Figure 12C:

FIGS. 12A-12C: Native SYFP2 fluorescence montage of a sagittal section of a whole mouse brain (12A), visual cortex (12B), and cerebellum (12C) showing selective expression of SYFP2 in cells with astrocyte morphology in the cortex and Bergmann glial morphology in the cerebellum after retro-orbital injection of CN2102 virus packaged with the PHP.eB capsid. This data shows that the eHGT_387m enhancer drives reporter expression selectively in mouse cells with astrocyte morphology, and Bergmann glia in the cerebellum.

Figure 13A:
Figure 13B:
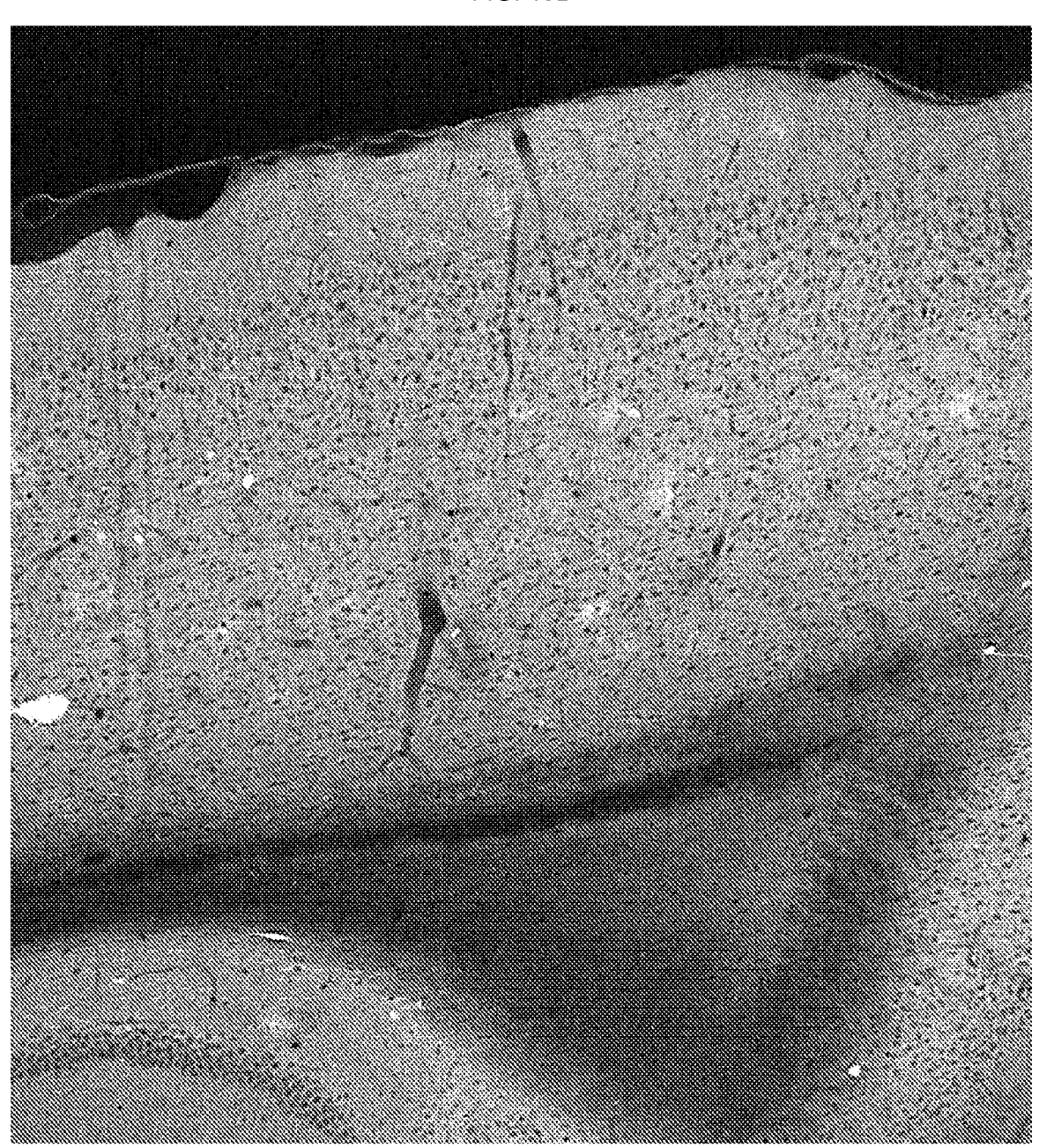

FIGS. 13A, 13B: Native SYFP2 fluorescence montage of a sagittal section of a whole mouse brain (13A) and visual cortex (13B) showing dim but selective expression of SYFP2 in cells with astrocyte morphology after retro-orbital injection of CN2103 virus packaged with the PHP.eB capsid. This data shows that the eHGT_388m enhancer drives reporter expression selectively in mouse cells with astrocyte morphology.

Figure 14A:
Figure 14B:
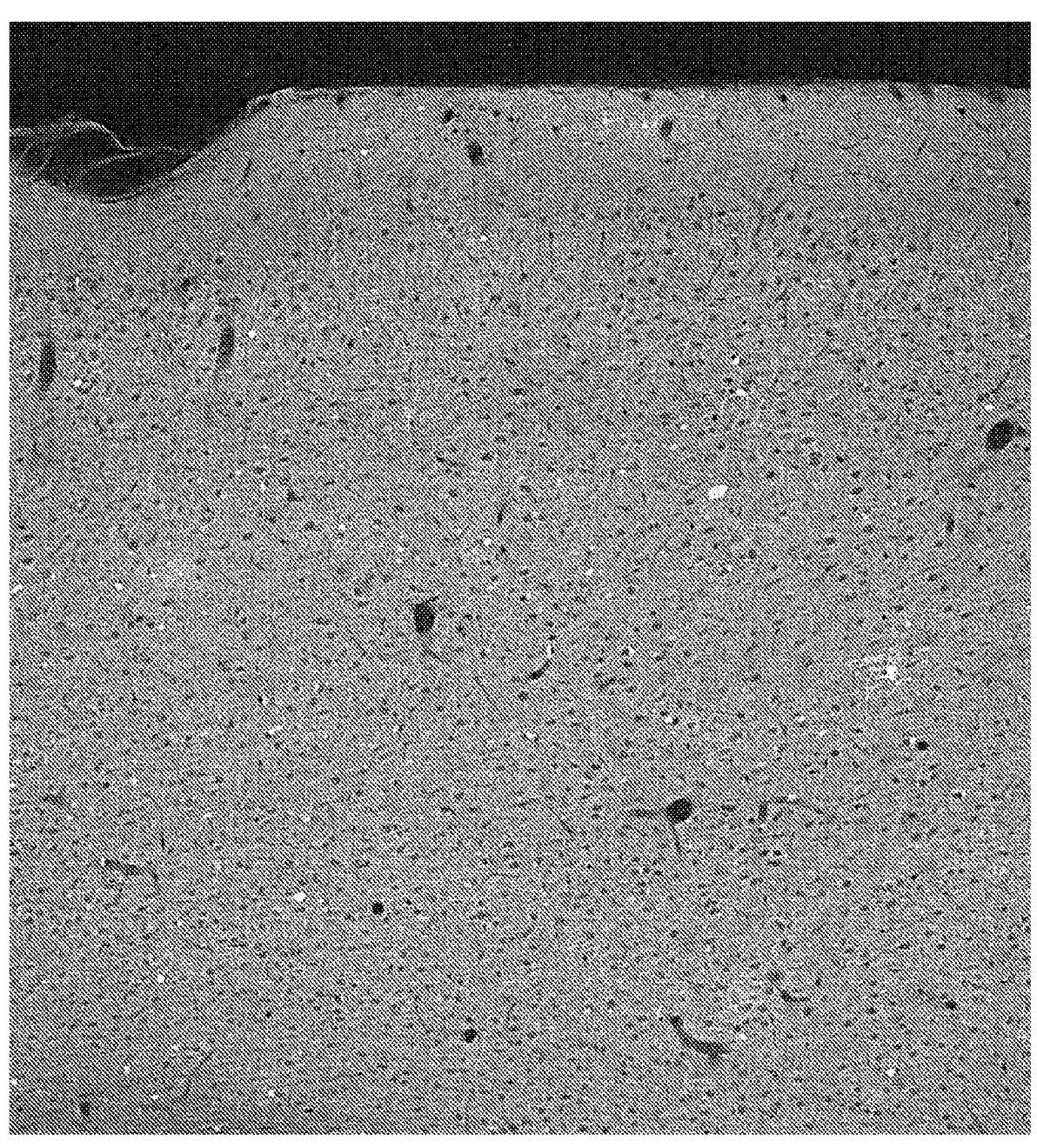

FIGS. 14A, 14B: Native SYFP2 fluorescence montage of a sagittal section of a whole mouse brain (14A) and visual cortex (14B) showing dim but selective expression of SYFP2 in cells with oligodendrocyte and OPC morphology after retro-orbital injection of CN2099 virus packaged with the PHP.eB capsid. This data shows that the eHGT_396m enhancer drives reporter expression selectively in mouse cells with astrocyte morphology.

Figure 15A:
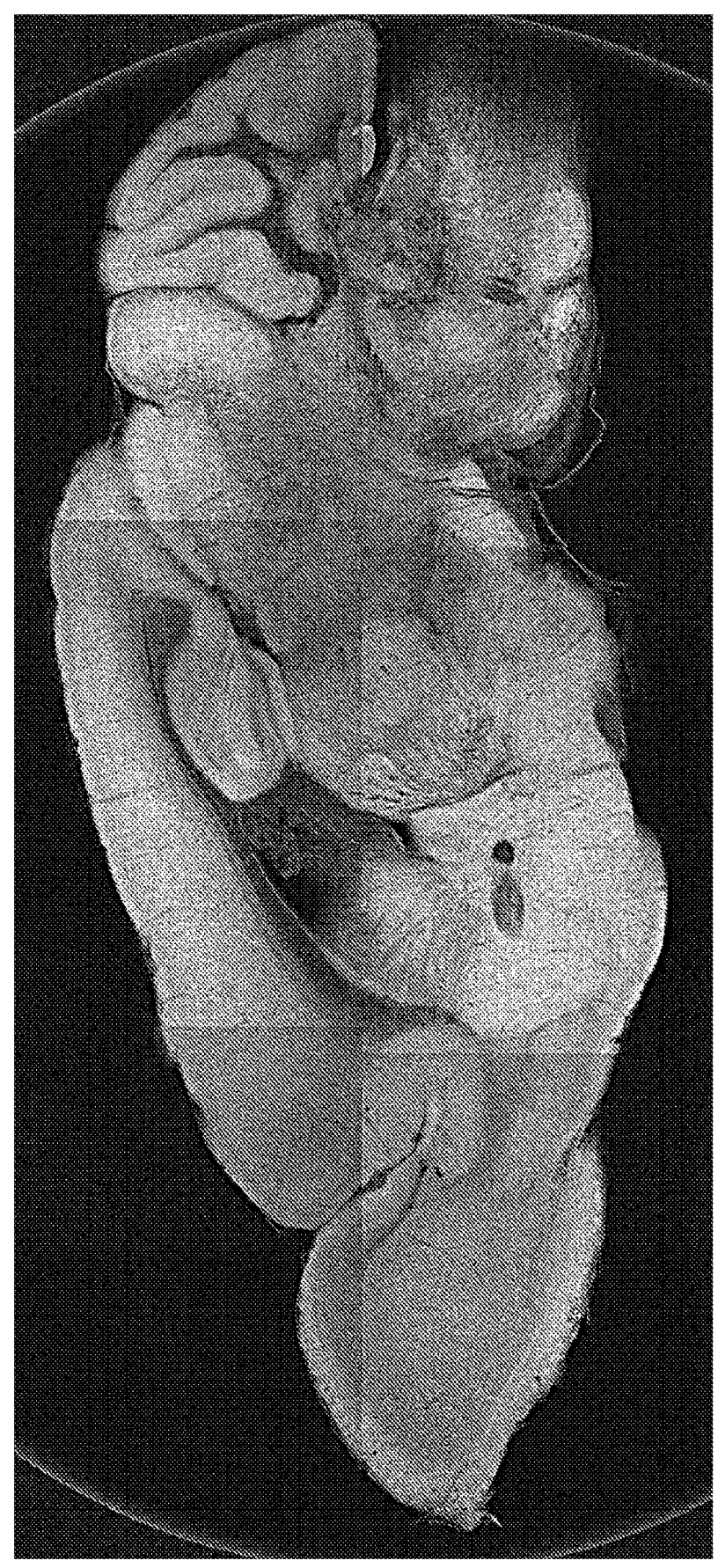
Figure 15B:

FIGS. 15A, 15B: Native SYFP2 fluorescence montage of a sagittal section of a whole mouse brain (15A) and visual cortex (15B) showing dim but selective expression of SYFP2 in cells with oligodendrocyte and OPC morphology after retro-orbital injection of CN2107 virus packaged with the PHP.eB capsid. This data shows that the eHGT_405m enhancer drives reporter expression selectively in mouse cells with oligodendrocyte morphology.

Figure 16A:
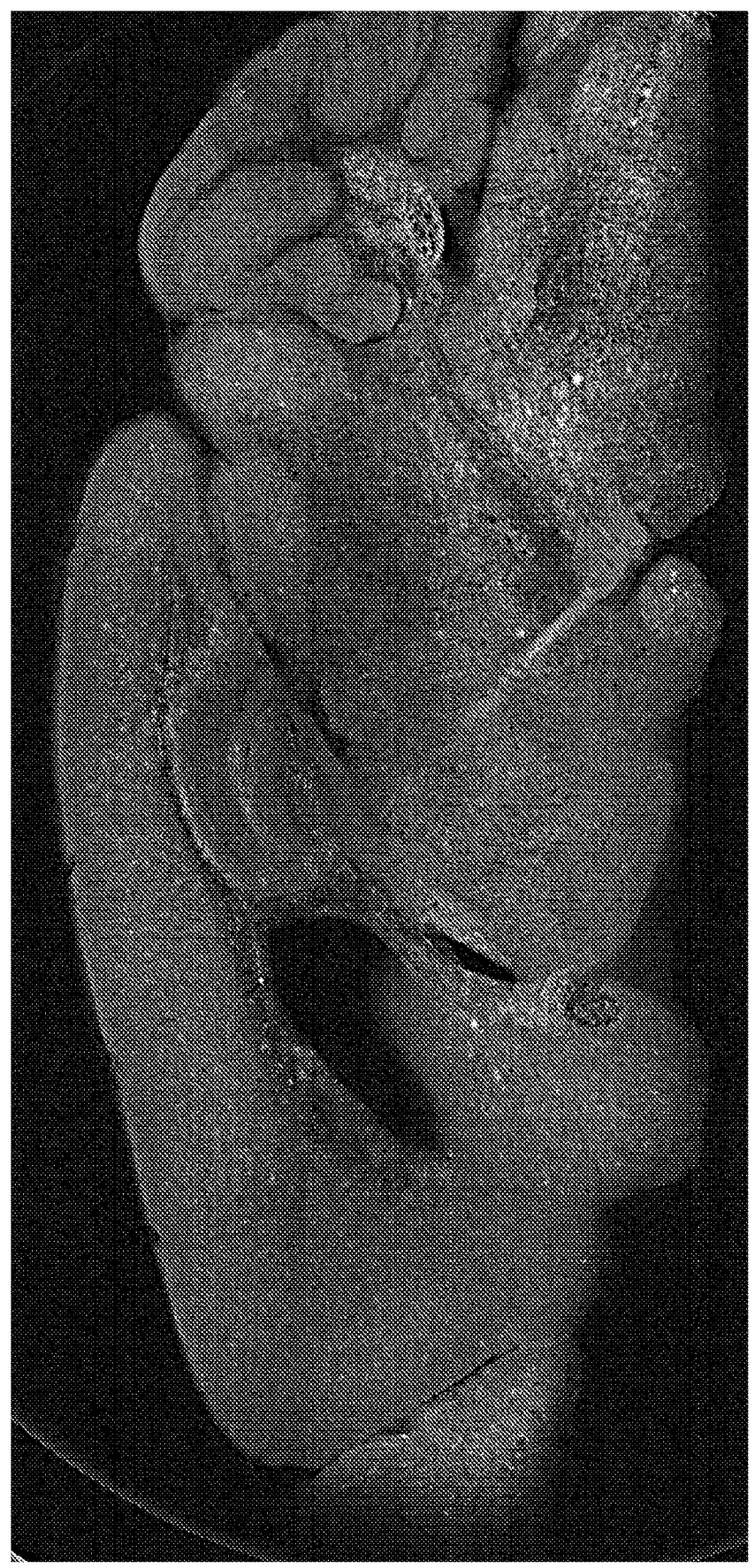
Figure 16B:
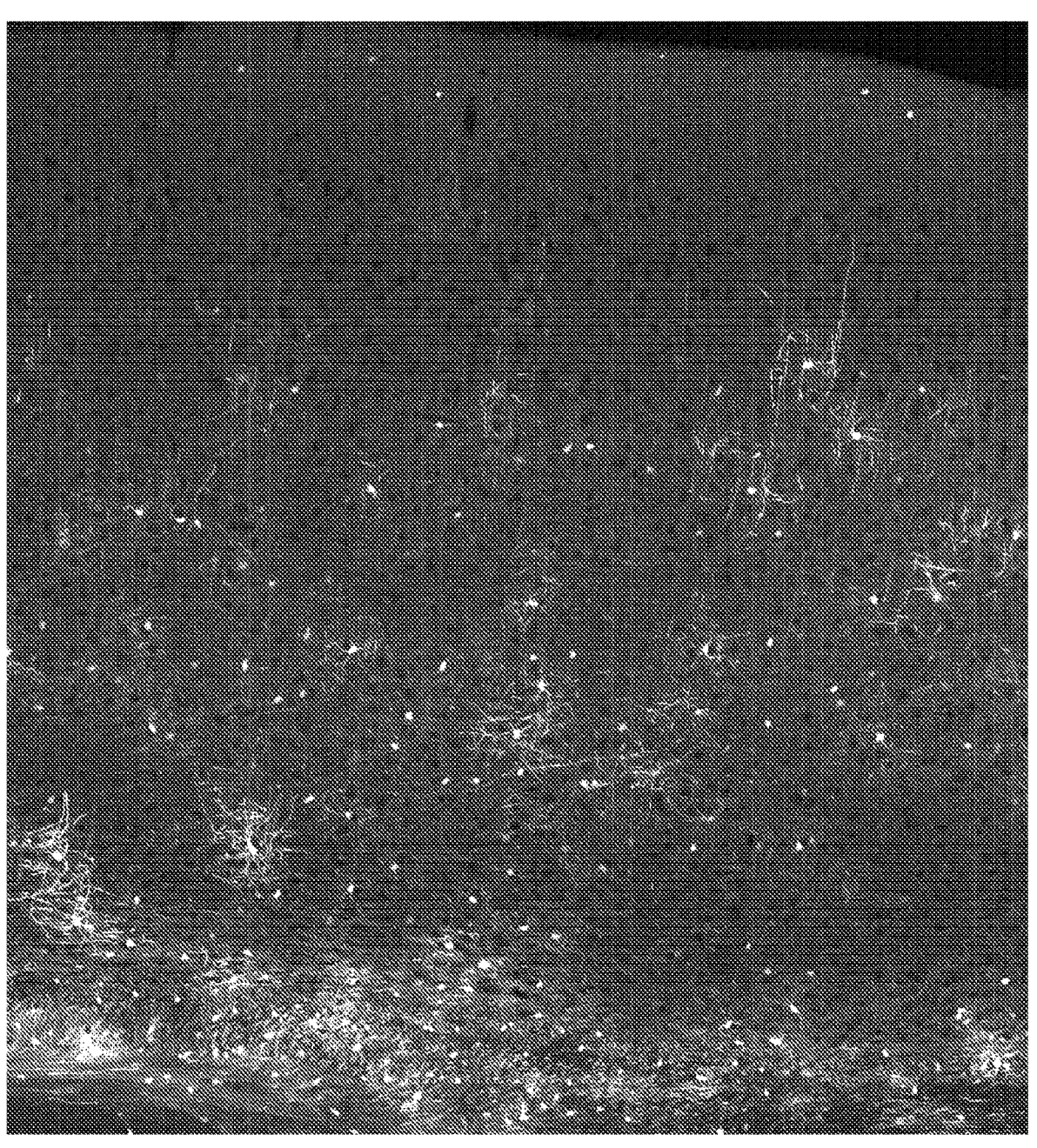

FIGS. 16A, 16B: Native SYFP2 fluorescence montage of a sagittal section of a whole mouse brain (16A) and visual cortex (16B) showing selective expression of SYFP2 in cells with oligodendrocyte morphology after retro-orbital injection of CN2093 virus packaged with the PHP.eB capsid. This data shows that the eHGT_409m enhancer drives reporter expression selectively in mouse cells with oligodendrocyte morphology.

Figure 17A:
Figure 17B:
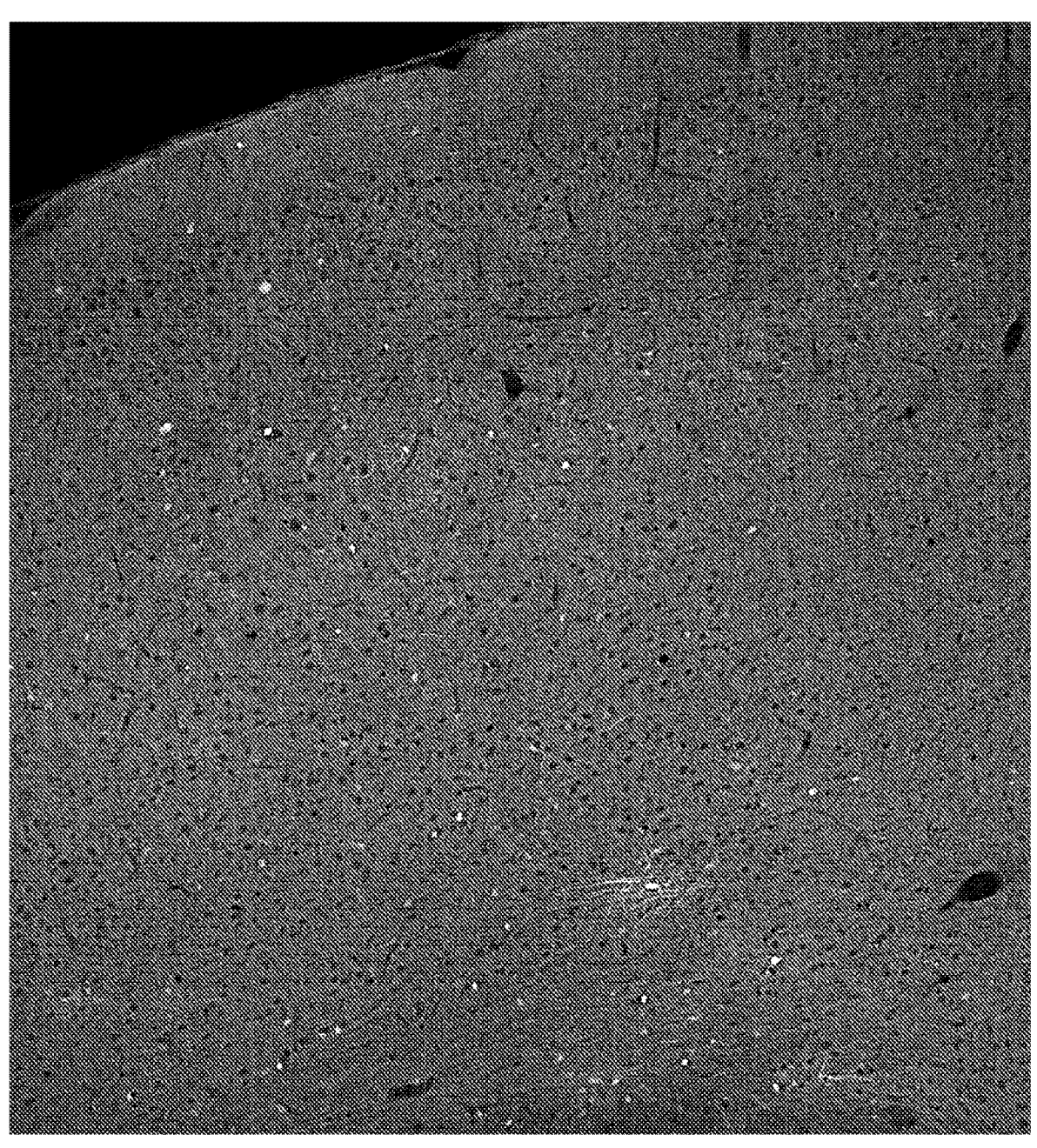

FIGS. 17A, 17B: Native SYFP2 fluorescence montage of a sagittal section of a whole mouse brain (17A) and visual cortex (17B) showing dim but selective expression of SYFP2 in cells with oligodendrocyte and OPC morphology after retro-orbital injection of CN2091 virus packaged with the PHP.eB capsid. This data shows that the eHGT_398m enhancer drives reporter expression selectively in mouse cells with oligodendrocyte morphology.

Figure 18A:
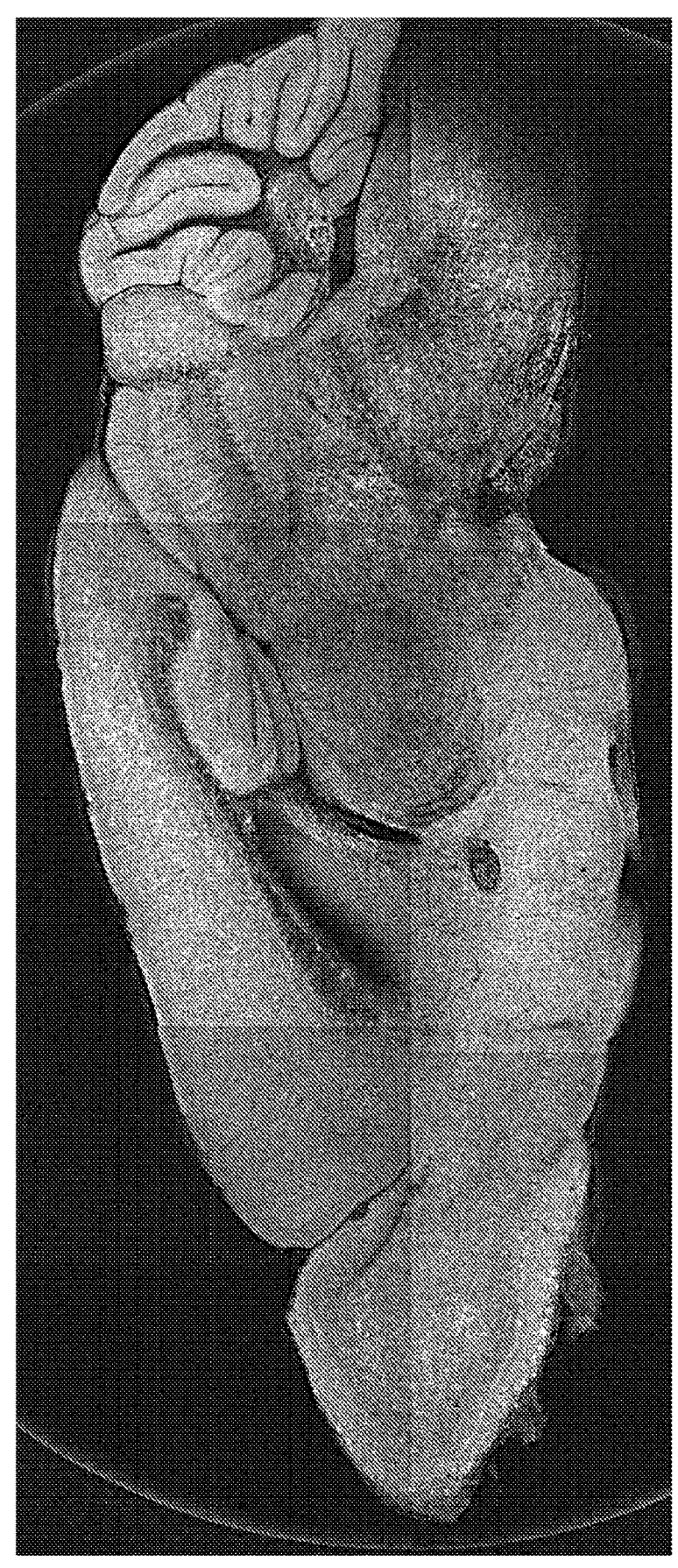
Figure 18B:
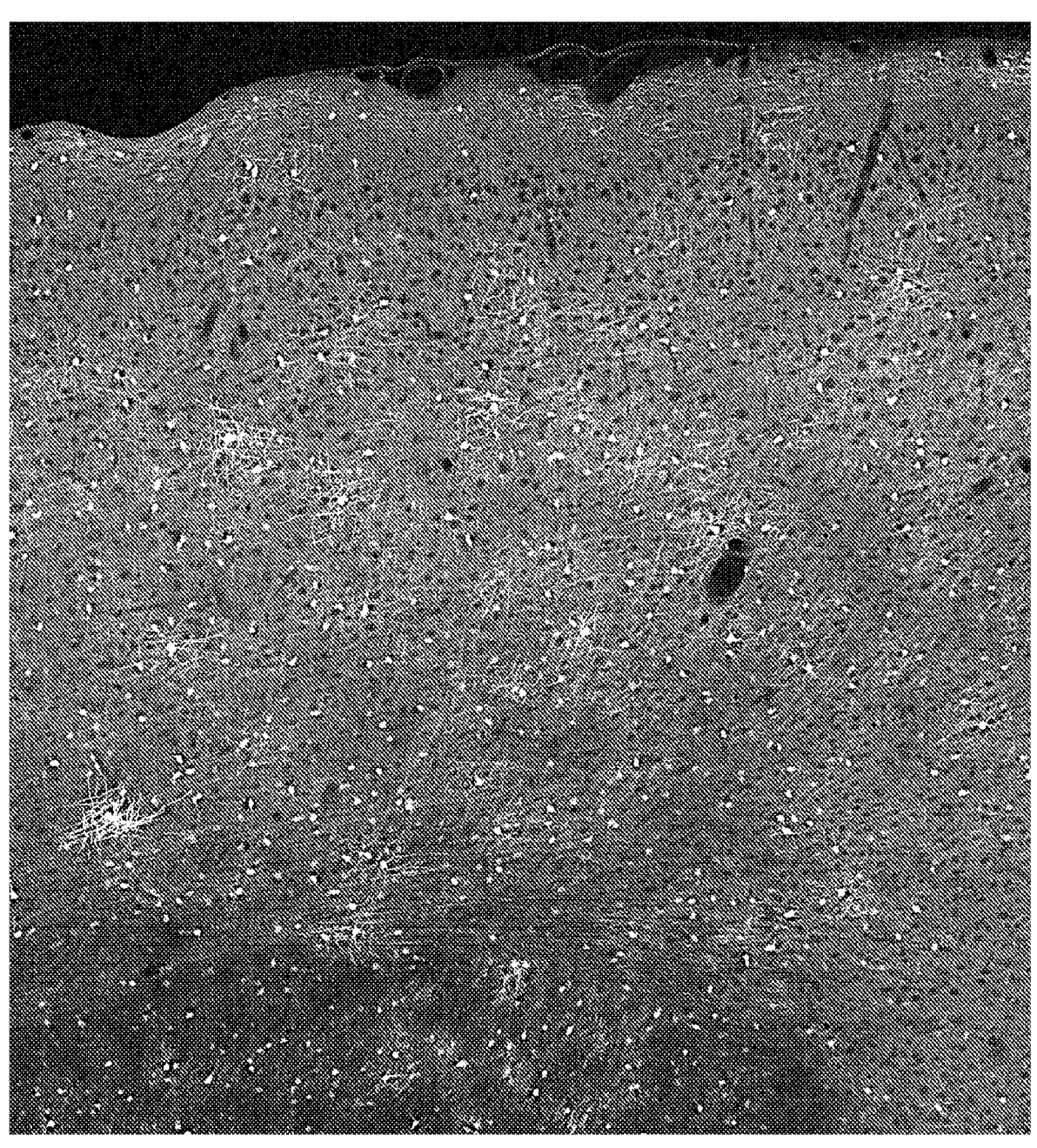

FIGS. 18A, 18B: Native SYFP2 fluorescence montage of a sagittal section of a whole mouse brain (18A) and visual cortex (18B) showing selective expression of SYFP2 in cells with oligodendrocyte morphology after retro-orbital injection of CN2106 virus packaged with the PHP.eB capsid. This data shows that the eHGT_400m enhancer drives reporter expression selectively in mouse cells with oligodendrocyte morphology.

Figure 19A:
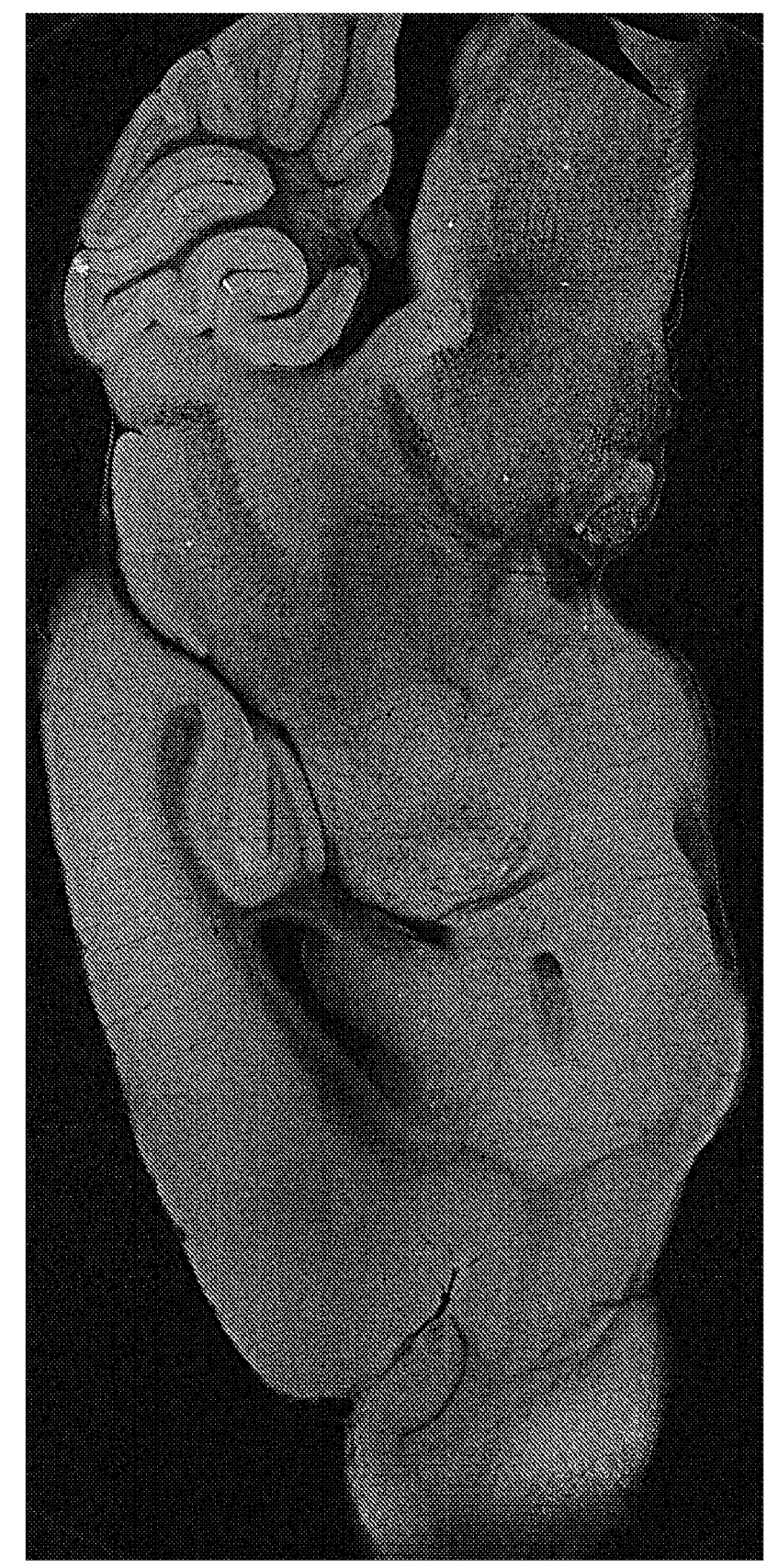
Figure 19B:
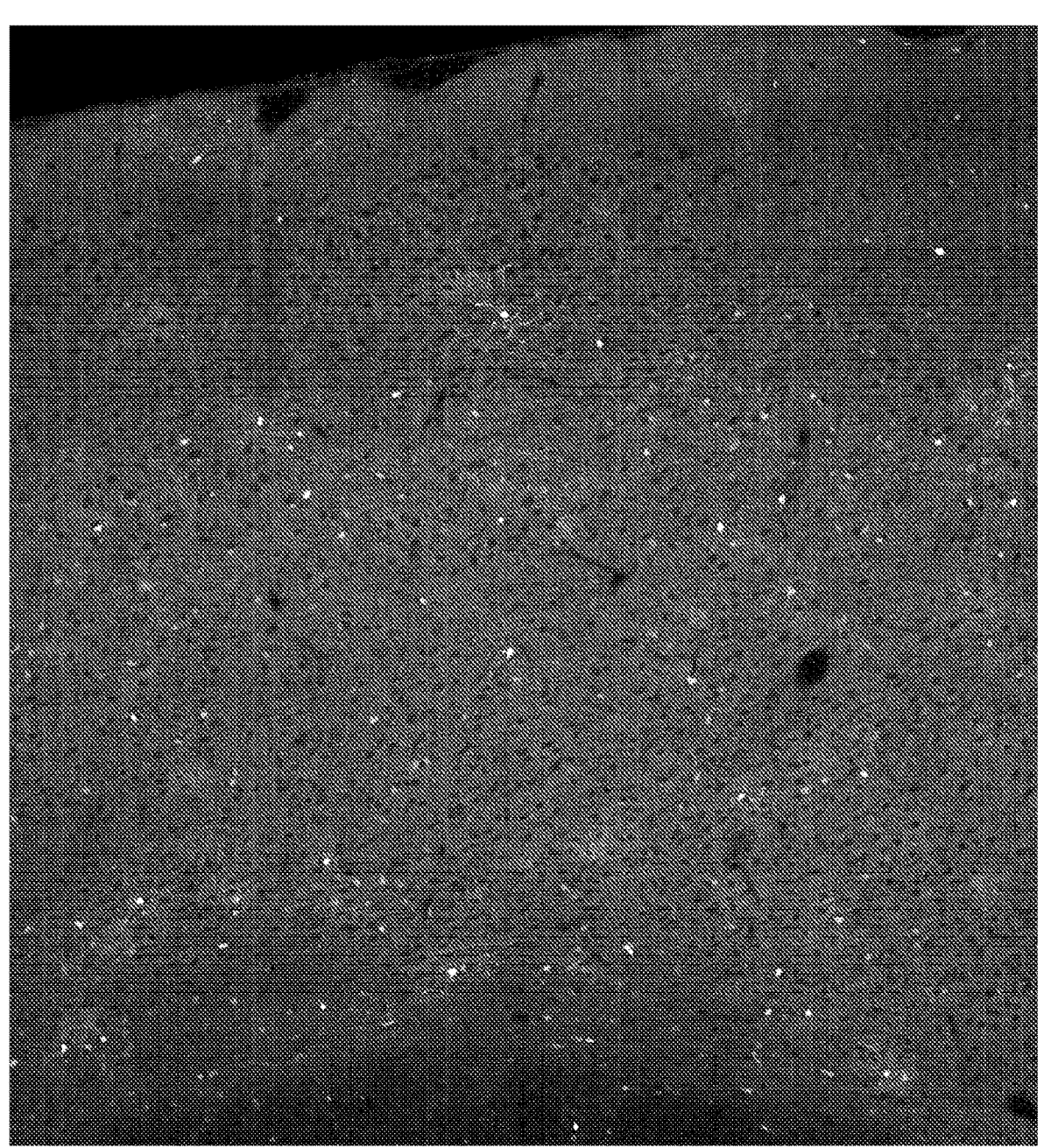
Figure 20A:
Figure 20B:
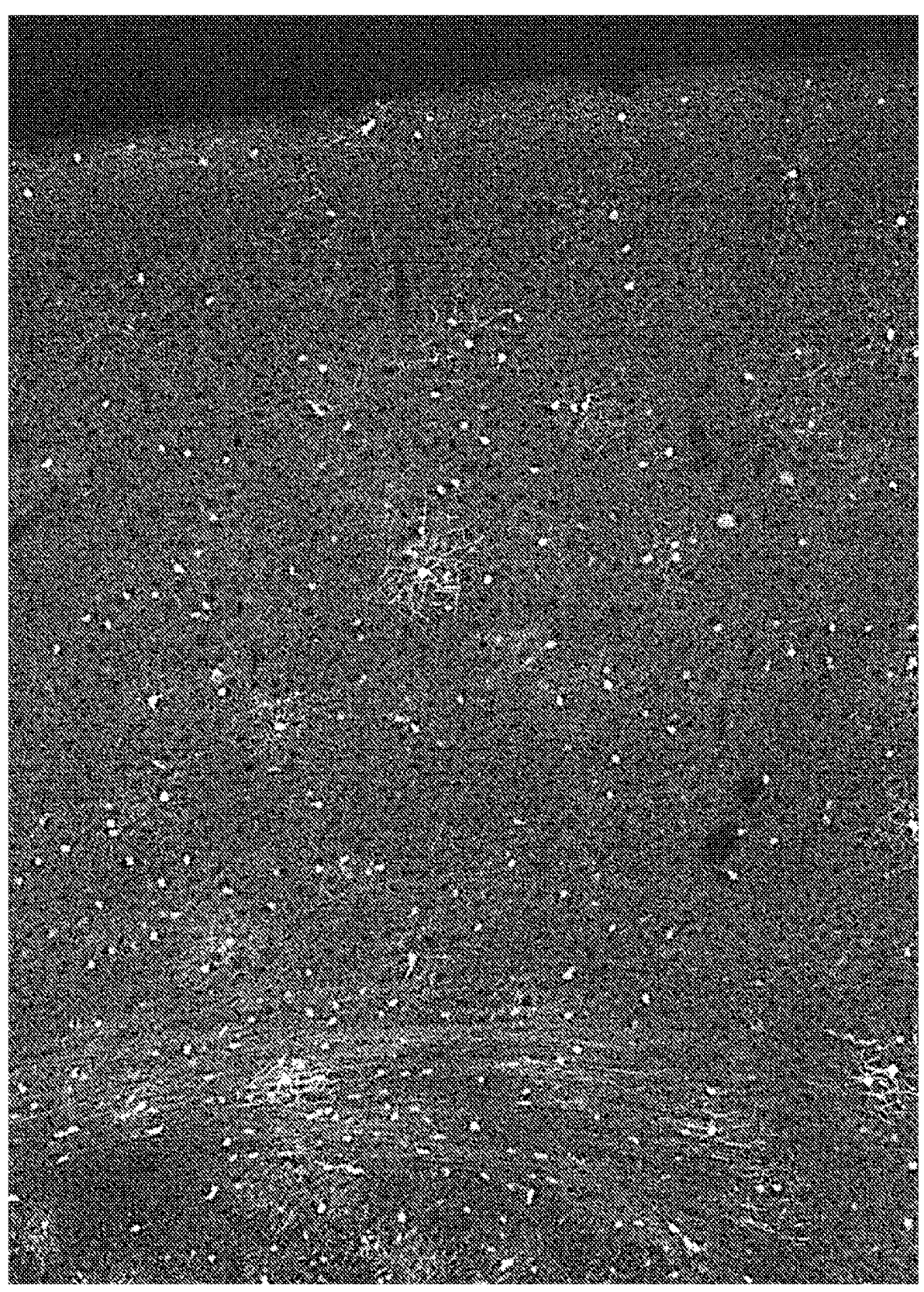
Figure 20C:

FIGS. 19A, 19B: Native SYFP2 fluorescence montage of a sagittal section of a whole mouse brain (19A) and visual cortex (19B) showing dim but selective expression of SYFP2 in cells with oligodendrocyte and OPC morphology after retro-orbital injection of CN2092 virus packaged with the PHP.eB capsid. This data shows that the eHGT_402m enhancer drives reporter expression selectively in mouse cells with oligodendrocyte morphology.

FIGSs. 20A-20C: Native SYFP2 fluorescence montage of a sagittal section of a whole mouse brain (20A), visual cortex (20B), and cerebellum and brainstem (20C) showing selective expression of SYFP2 in cells with oligodendrocyte morphology after retro-orbital injection of CN2157 virus packaged with the PHP.eB capsid. This data shows that the eHGT_395h enhancer drives reporter expression selectively in mouse cells with oligodendrocyte morphology in multiple brain regions including midbrain and hindbrain structures.

Figure 21A:
Figure 21B:

FIGS. 21A, 21B: Native SYFP2 fluorescence montage of a sagittal section of a whole mouse brain (21A) and visual cortex (21B) showing dim but selective expression of SYFP2 in cells with oligodendrocyte and OPC morphology after retro-orbital injection of CN2167 virus packaged with the PHP.eB capsid. This data shows that the eHGT_407h enhancer drives reporter expression selectively in mouse cells with oligodendrocyte morphology.

Figure 22A:
Figure 22B:
Figure 23A:
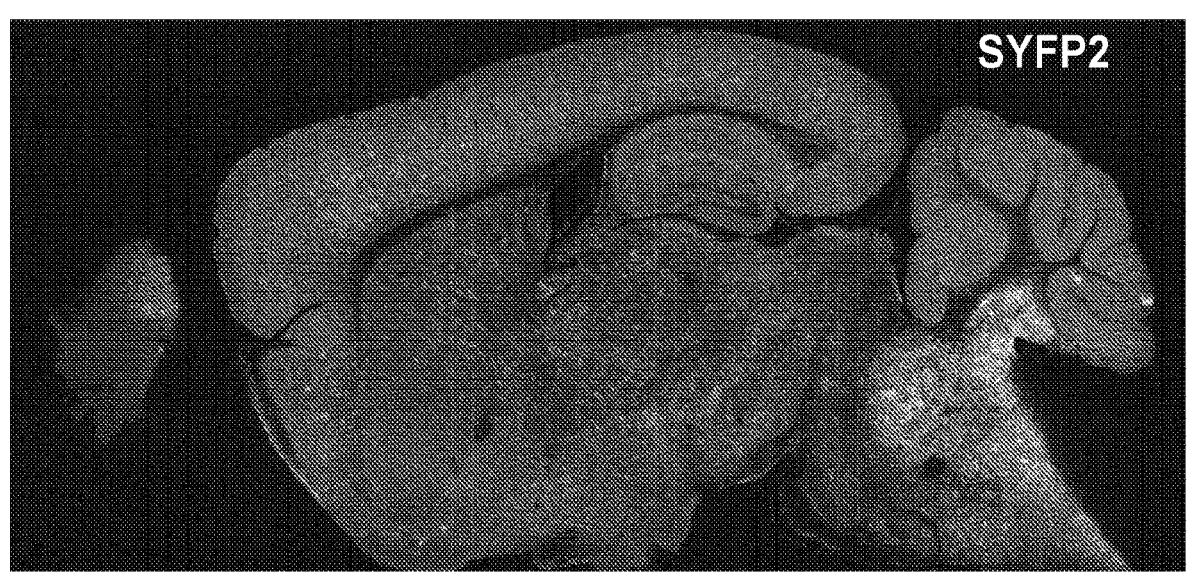
Figure 23B:
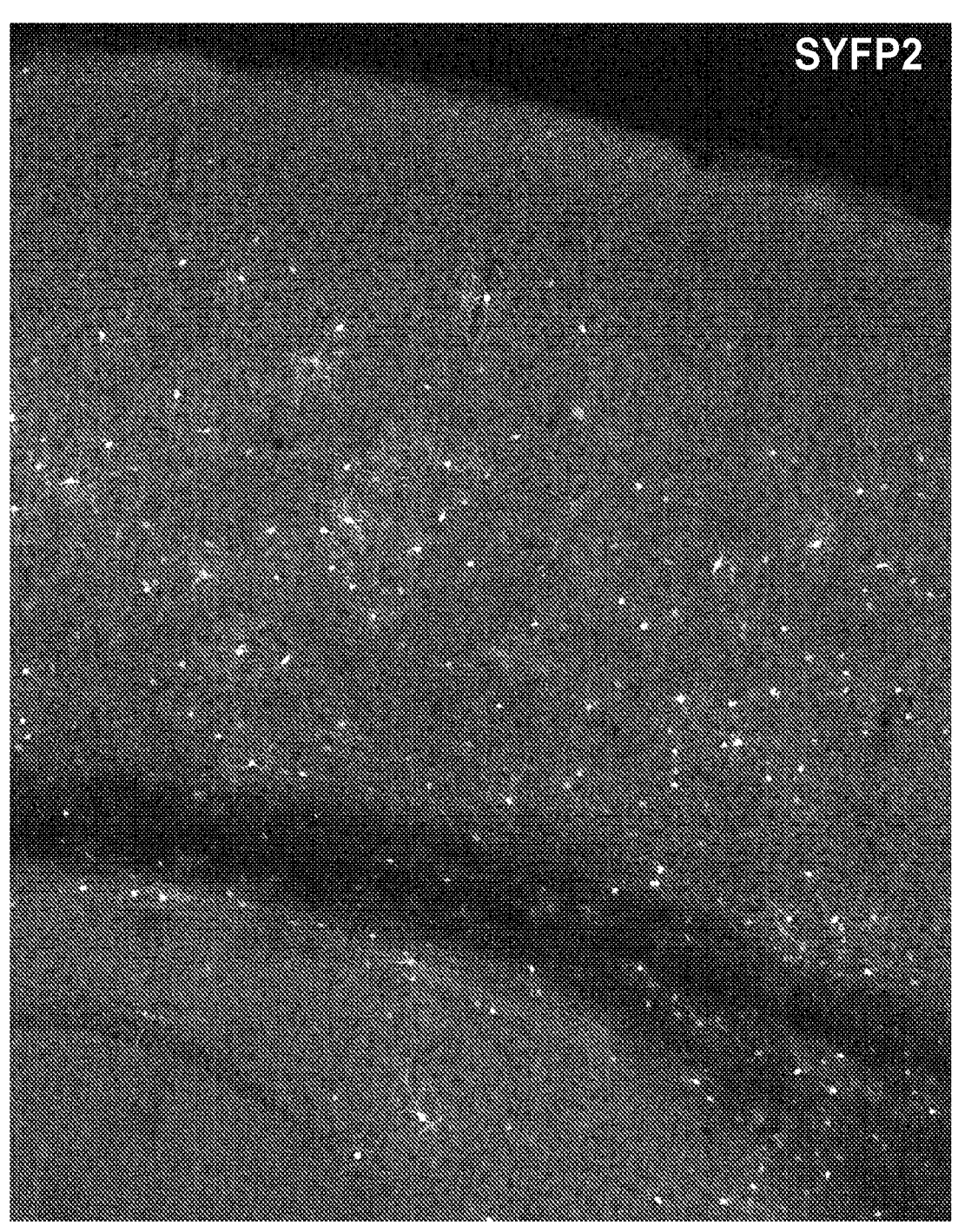
Figure 23C:
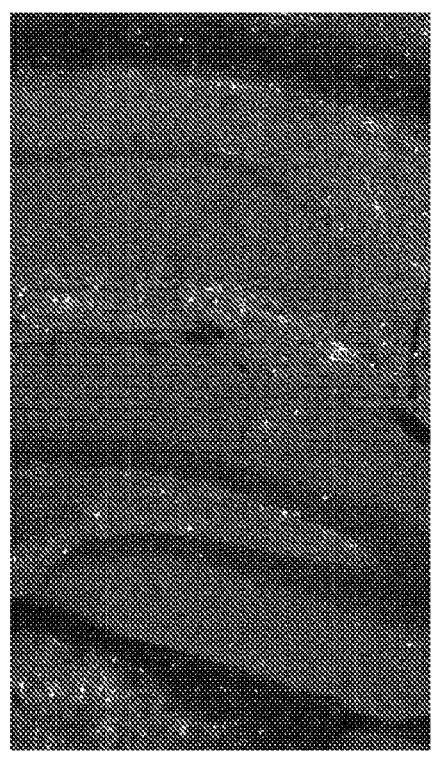
Figure 23D:
Figure 23E:
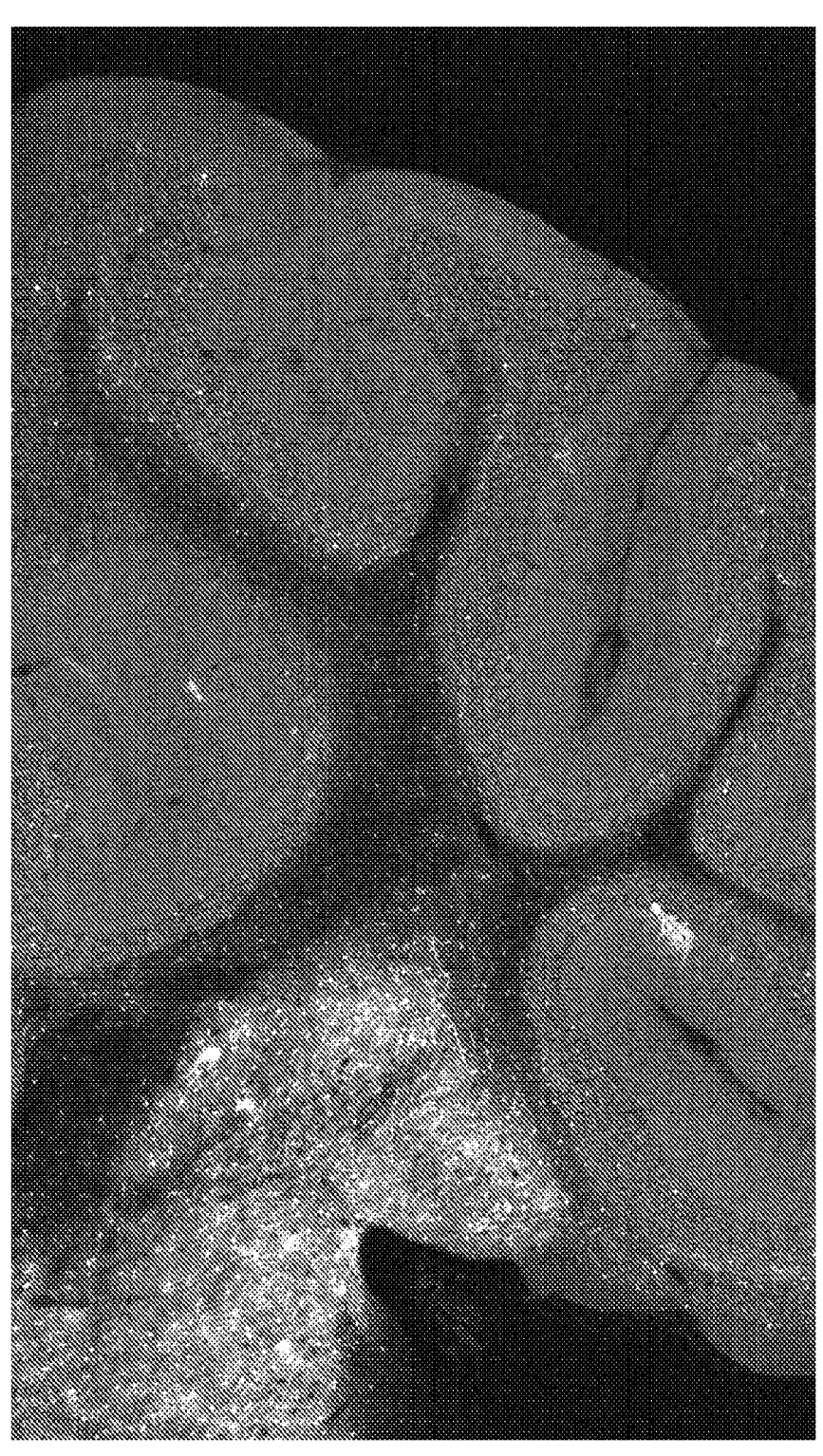
Figure 24A:
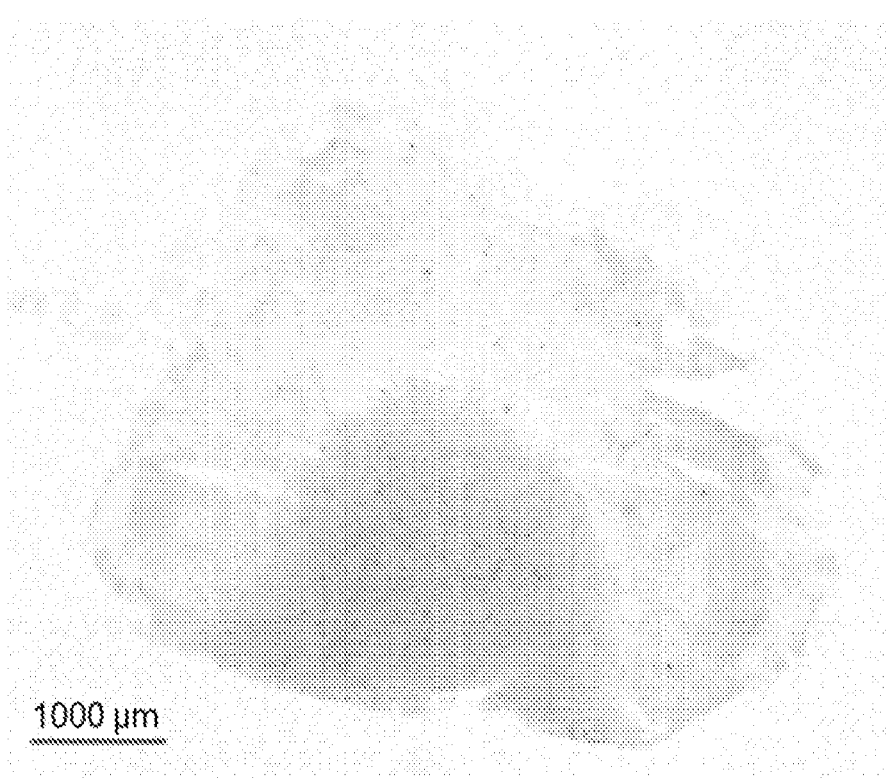
Figure 24B:
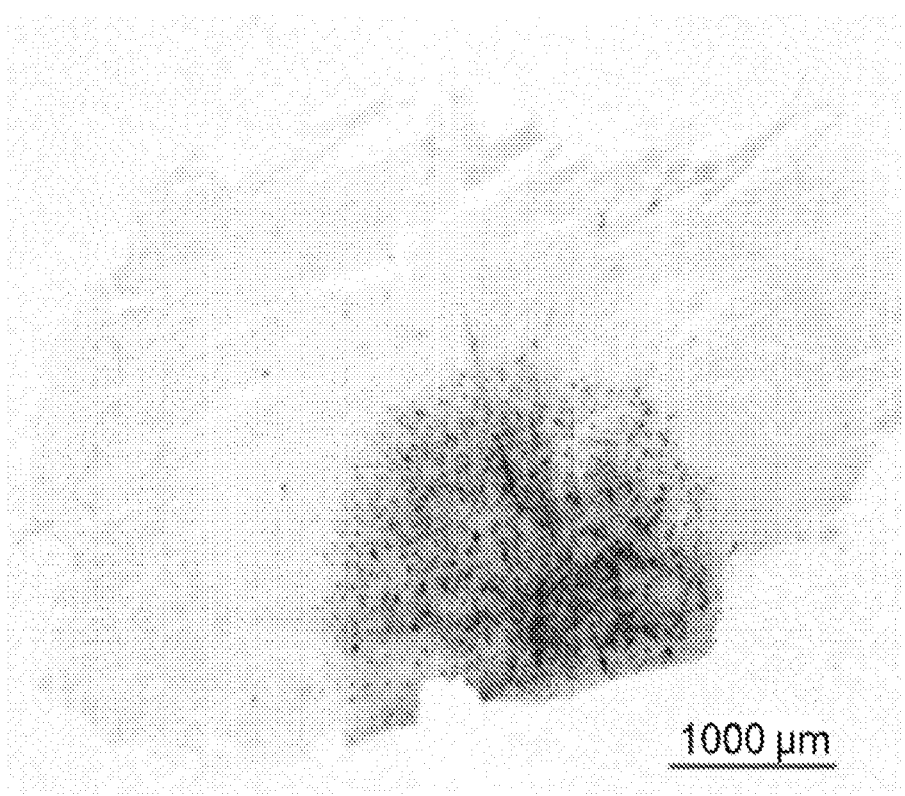
Figure 24C:
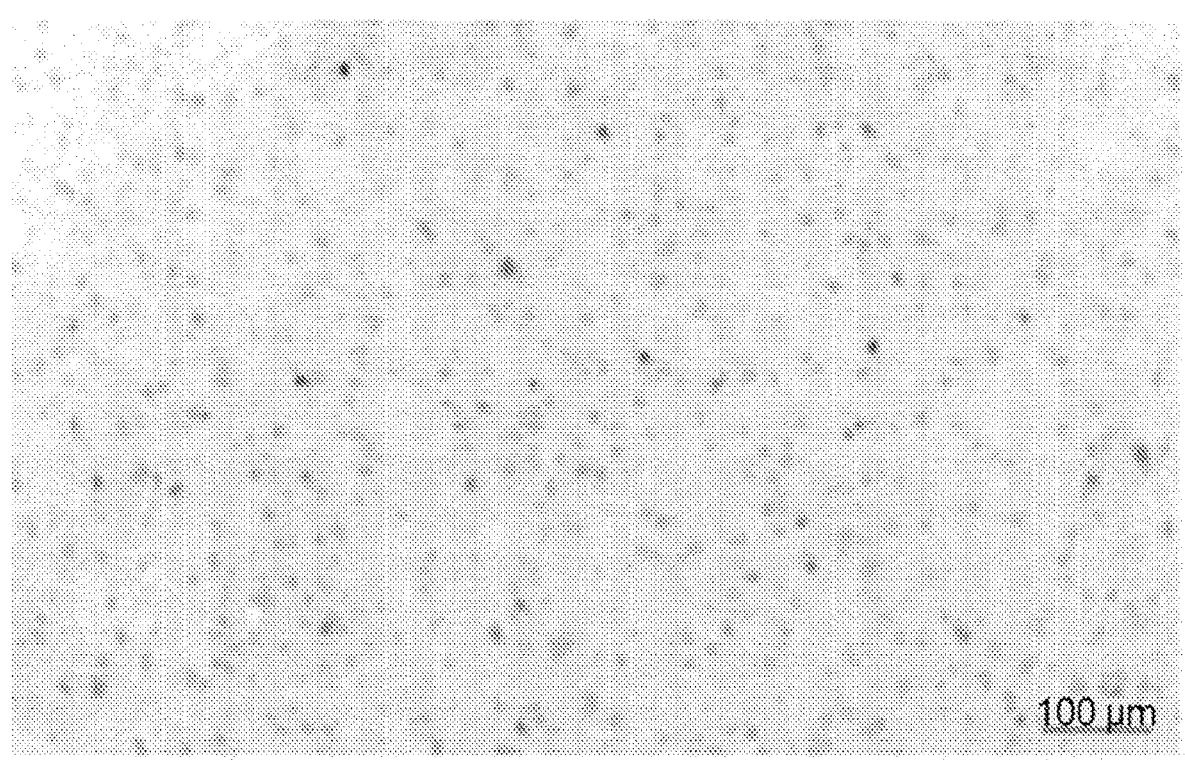
Figure 24D:
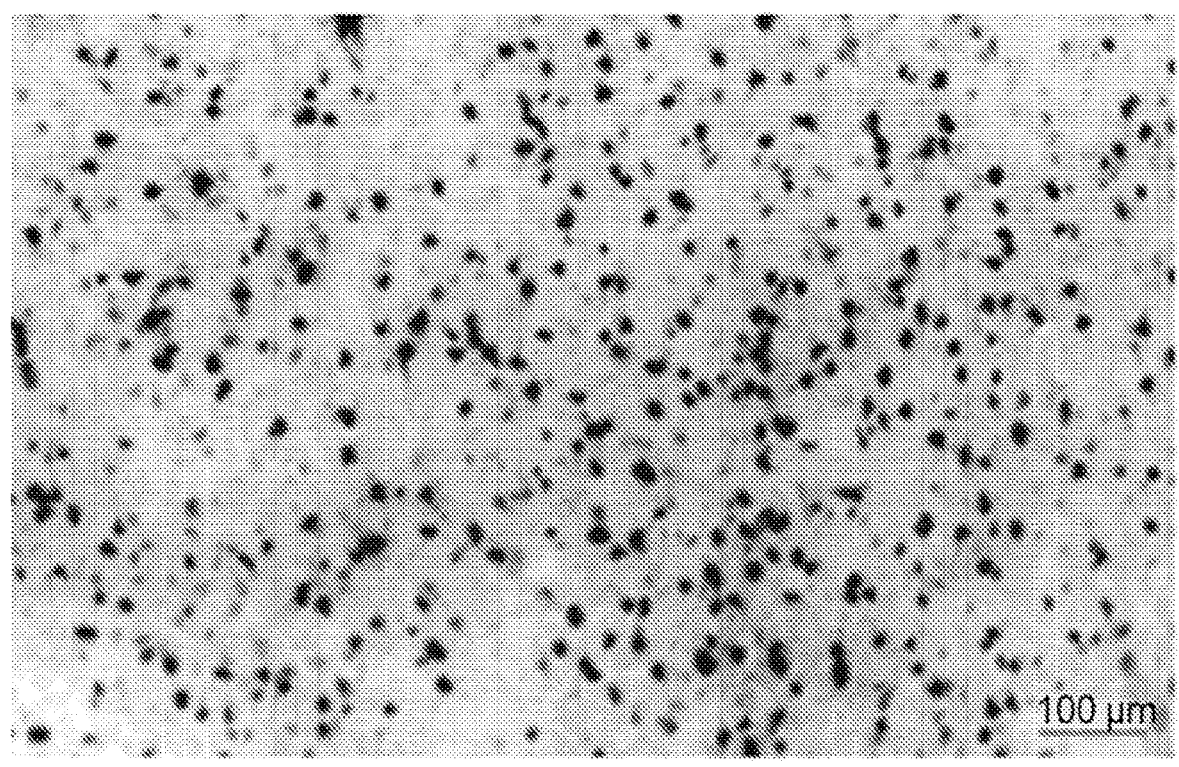

FIGS. 22A, 22B: Native SYFP2 fluorescence montage of a sagittal section of a whole mouse brain (22A) and visual cortex (22B) showing dim but selective expression of SYFP2 in cells with oligodendrocyte and OPC morphology after retro-orbital injection of CN2159 virus packaged with the PHP.eB capsid. This data shows that the eHGT_397h enhancer drives reporter expression selectively in mouse cells with oligodendrocyte morphology.

FIGS. 23A-23E: Native SYFP2 fluorescence montage of a sagittal section of a whole mouse brain (23A), visual cortex (23B), hippocampus (23C), striatum (23D), and cerebellum (23E) showing selective expression of SYFP2 in cells with oligodendrocyte morphology after retro-orbital injection of CN2845 virus packaged with the PHP.eB capsid. This data shows that the eHGT_641m enhancer drives reporter expression selectively in mouse cells with oligodendrocyte morphology in the cortex, hippocampus, striatum, and brainstem.

FIG. 24A-24D. Validation of optimized oligodendrocyte enhancer AAV vectorCN2556 in adult macaque neocortical slice culture. (24A, 24B) SYFP2 reporter expression enriched in white matter oligodendrocytes for full length enhancer eHGT_410m (24A—CN2109 serotypePHP.eB) versus 3xCore-eHGT_410m enhancer (24B—CN2556 serotypePHP.eB) under matched conditions. Scale bar: 1 mm. (24C, 24D) Higher magnification view show ingnative SYFP2 signal in cells with oligodendrocyte morphology in the white matter region for full length enhancer eHGT_410m (24C—CN2109serotypePHP.eB) versus 3xCore-eHGT_410m enhancer (24D—CN2556serotypePHP.eB) under matched conditions. Scale bar: 100 microns.

FIG. 25. Enhancer names, lengths, and sequences.

FIG. 26. Vector names, lengths (between ITRs), and sequences.

FIG. 27. Exemplary sequences of subcomponents for use with artificial expression constructs disclosed herein.

DETAILED DESCRIPTION

To fully understand the biology of the brain, different cell types need to be distinguished and defined and, to further study them, artificial expression constructs that can selectively label and perturb them need to be identified. Tasic, Curr. Opin. Neurobiol. 50, 242-249 (2018); Zeng & Sanes, Nat. Rev. Neurosci. 18, 530-546 (2017). In mouse, recombinase driver lines have been used to great effect to label cell populations that share marker gene expression. Daigle et al., Cell 174, 465-480.e22 (2018); Taniguchi, et al., Neuron 71, 995-1013 (2011); Gong et al., J. Neurosci. 27, 9817-9823 (2007). However, the creation, maintenance, and use of such lines that label cell types with high specificity can be costly, frequently requiring triple transgenic crosses, which yield a low frequency of experimental animals. Furthermore, those tools require germline transgenic animals and thus are not applicable to humans.

The current disclosure provides artificial expression constructs that selectively drive gene expression in targeted central nervous system cell populations. Targeted central nervous system cell populations are non-neuronal brain cells including astrocytes, oligodendrocytes, microglia, pericytes, SMC, and endothelial cells.

Particular embodiments of the artificial expression constructs utilize the following enhancers to selectively drive gene expression within targeted central nervous system cell populations as follows:

astrocytes: eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, and mscRE1007;

L1 interlaminar astrocytes: eHGT_267h, eHGT_268h, eHGT_269h, eHGT_270h, eHGT_271h, eHGT_272h, eHGT_273h, eHGT_274h, eHGT_275h, eHGT_276h, eHGT_315h, and eHGT_316h;

oligodendrocytes: eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, and eHGT_408h;

microglia: eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, and eHGT_430h;

pericytes: mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, and mscRE1037;

SMC: mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, and mscRE1052; and endothelial cells: mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, and mscRE1022.

Particular embodiments provide artificial expression constructs including the features of vectors described herein including vectors: CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155, CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, and 3052.

Aspects of the disclosure are now described with the following additional options and detail: (i) Artificial Expression Constructs & Vectors for Selective Expression of Genes in Selected Cell Types; (ii) Compositions for Administration (iii) Cell Lines Including Artificial Expression Constructs; (iv) Transgenic Animals; (v) Methods of Use; (vi) Kits and Commercial Packages; (vii) Exemplary Embodiments; (viii) Experimental Methods and (ix) Closing Paragraphs. These headings are provided for organizational purposes only and do not limit the scope or interpretation of the disclosure.

(i) Artificial Expression Constructs & Vectors for Selective Expression of Genes in Selected Cell Types. Artificial expression constructs disclosed herein include (i) an enhancer sequence that leads to selective expression of a coding sequence within a targeted central nervous system cell type, (ii) a coding sequence that is expressed, and (iii) a promoter. The artificial expression construct can also include other regulatory elements if necessary or beneficial.

In particular embodiments, an "enhancer" or an "enhancer element" is a cis-acting sequence that increases the level of transcription associated with a promoter and can function in either orientation relative to the promoter and the coding sequence that is to be transcribed and can be located upstream or downstream relative to the promoter or the coding sequence to be transcribed. There are art-recognized methods and techniques for measuring function(s) of enhancer element sequences. Particular examples of enhancer sequences utilized within artificial expression constructs disclosed herein include eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_357h, eHGT_371h, eHGT_371m, eHGT_372h, eHGT_372m, eHGT_373m, 3xcore eHGT_373m, eHGT_374m, eHGT_375h, eHGT_375m, eHGT_376h, eHGT_376m, eHGT_377h, eHGT_379m, eHGT_380m, eHGT_381h, eHGT_381m, eHGT_382h, eHGT_382m, eHGT_383h, eHGT_383m, eHGT_384h, eHGT_384m, eHGT_385m, eHGT_386m, eHGT_387h, eHGT_387m, eHGT_388h, eHGT_388m, eHGT_389h, eHGT_390h, eHGT_390m, 3xcore eHGT_390m, eHGT_391m, eHGT_392h, eHGT_393h, eHGT_393m, eHGT_394h, eHGT_395h, eHGT_396h, eHGT_396m, eHGT_397h, eHGT_397m, eHGT_398h, eHGT_398m, eHGT_399h, eHGT_399m, eHGT_400h, eHGT_400m, eHGT_401m, eHGT_402h, eHGT_402m, eHGT_403m, eHGT_404h, eHGT_405h, eHGT_405m, eHGT_406h, eHGT_406m, eHGT_407h, eHGT_641m, eHGT_407m, eHGT_408h, eHGT_408m, eHGT_409m, eHGT_410m, 3xcore eHGT_410m, eHGT_411h, eHGT_411m, eHGT_412h, eHGT_412m, eHGT_413h, eHGT_414h, eHGT_414m, eHGT_415m, eHGT_416m, eHGT_417h, eHGT_417m, eHGT_418h, eHGT_418m, eHGT_419h, eHGT_419m, eHGT_420h, eHGT_420m, eHGT_421m, eHGT_422m, eHGT_423h, eHGT_423m, eHGT_424h, eHGT_424m, eHGT_425h, eHGT_425m, eHGT_426h, eHGT_426m, eHGT_427h, eHGT_427m, eHGT_428h, eHGT_428m, eHGT_429h, eHGT_429m, eHGT_430h, eHGT_430m, eHGT_495m, eHGT_497m, eHGT413m, mscRE1001, mscRE1002, mscRE1003, mscRE1004, mscRE1005, mscRE1006, mscRE1007, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, mscRE1022, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, and mscRE1052.

In particular embodiments, a targeted central nervous system cell type enhancer is an enhancer that is uniquely or predominantly utilized by the targeted central nervous system cell type. A targeted central nervous system cell type enhancer enhances expression of a gene in the targeted central nervous system cell type but does not substantially direct expression of genes in other non-targeted cell types, thus having cell type specific transcriptional activity.

When a coding sequence is selectively expressed in selected cells and is not substantially expressed in other cell types, the product of the coding sequence is preferentially expressed in the selected cell type. In particular embodiments, preferential expression is greater than 50% expression as compared to a reference cell type; greater than 60% expression as compared to a reference cell type; greater than 70% expression as compared to a reference cell type; greater than 80% expression as compared to a reference cell type; or greater than 90% expression as compared to a reference cell type. In particular embodiments, a reference cell type refers to non-targeted cells. The non-targeted cells can be within the same anatomical structure as the targeted cells and/or can project to a common anatomical area. In particular embodiments, a reference cell type is within an anatomical structure that is adjacent to an anatomical structure that includes the targeted cell type. In particular embodiments, a reference cell type is a non-targeted cell with a different gene expression profile than the targeted cells.

In particular embodiments, the product of the coding sequence may be expressed at low levels in non-selected cell types, for example at less than 1% or 1%, 2%, 3%, 5%, 10%, 15% or 20% of the levels at which the product is expressed in selected cells. In particular embodiments, the targeted central nervous system cell type is the only cell type that expresses the right combination of transcription factors that bind an enhancer disclosed herein to drive gene expression. Thus, in particular embodiments, expression occurs exclusively within the targeted cell type.

In particular embodiments, targeted cell types (e.g. non-neuronal cell types described herein) can be identified based on transcriptional profiles, such as those described in Tasic et al., Nature, 563, 72-78 (2018) and Hodge et al., Nature 573, 61-68 (2019). For reference, the following description of cell types and distinguishing features is also provided:

Neoortical GABAergic Neuron Subclasses:

All: Express GABA synthesis genes Gad1/GAD1 and Gad2/GAD2.

Lamp5, Sncg, Serpinf1, and Vip GABAergic neurons: Developmentally derived from neuronal progenitors from the caudal ganglionic eminence (CGE) or preoptic area (POA).

Sst and Pvalb GABAergic neurons: Developmentally derived from neuronal progenitors in the medial ganglionic eminence (MGE).

Lamp5 GABAergic neurons: Found in many neocortical layers, especially upper (L1-L2/3), and have mainly neurogliaform and single bouquet morphology.

Sncg GABAergic neurons: Found in many neocortical layers, and have molecular overlaps with Lamp5 and Vip cells, but inconsistent expression of Lamp5 or Vip, with more consistent expression of Sncg.

Serpinf1 GABAergic neurons: Found in many neocortical layers, and have molecular overlaps with Sncg and Vip cells, but inconsistent expression of Sncg or Vip, with more consistent expression of Serpinf1.

Vip GABAergic neurons: Found in many neocortical layers, but especially frequent in upper layers (L1-L4), and highly express the neurotransmitter vasoactive intestinal peptide (Vip).

Sst GABAergic neurons: Found in many neocortical layers, but especially frequent in lower layers (L5-L6). They highly express the neurotransmitter somatostatin (Sst), and frequently block dendritic inputs to postsynaptic neurons. Included in this subclass are sleep-active Sst Chodl neurons (which also express Nos1 and Tacr1) that are highly distinct from other Sst neurons but express some shared marker genes including Sst. In human, SST gene expression is often detected in layer 1 LAMP5+ GABAergic neuron subtypes.

Pvalb GABAergic neurons: Found in many neocortical layers, but especially frequent in lower layers (L5-L6). They highly express the calcium-binding protein parvalbumin (Pvalb), express neuropeptide Tac1, and frequently dampen the output of postsynaptic neurons. Most fast-spiking GABAergic neurons express Pvalb strongly. Included in this subclass are chandelier cells, which have distinct, chandelier-like morphology and express the markers Cpne5 and Vipr2 in mouse, and NOG and UNCSB in human.

Meis2: A distinct subclass defined by a single type, only neocortical GABAergic type that expresses Meis2 gene, and does not express some other genes that are expressed by all other neocortical GABAergic neuron types (for example, Thy1 and Scn2b). This type is found in L6b and subcortical white matter.

Neocortical Glutamatergic Neuron Subclasses:

All glutamatergic neurons: Express glutamate transmitters Slc17a6 and/or Slc17a7. They all express Snap25 and lack expression of Gad1/Gad2.

L2/3 IT glutamatergic neurons: Primarily reside in Layer 2/3 and have mainly intratelencephalic (cortico-cortical) projections.

L4 IT glutamatergic neurons: Primarily reside in Layer 4 and mainly have either local or intratelencephalic (cortico-cortical) projections.

L5 IT glutamatergic neurons: Primarily reside in Layer 5 and have mainly intratelencephalic (cortico-cortical) projections. Also called L5a.

L5 PT glutamatergic neurons: Primarily reside in Layer 5 and have mainly cortico-subcortical (pyramidal tract or corticofugal) projections. Also called L5b or L5 CF (corticofugal) or L5 ET (extratelencephalic). This subclass includes cells that are located in the primary motor cortex and neighboring areas and are corticospinal projection neurons, which are associated with motor neuron/movement disorders, such as ALS. This subclass includes thick-tufted pyramidal neurons, including distinctive subtypes found only in specialized regions, e.g. Betz cells, Meynert cells, and von Economo cells.

L5 NP glutamatergic neurons: Primarily reside in Layer 5 and have mainly nearby projections.

L6 CT glutamatergic neurons: Primarily reside in Layer 6 and have mainly cortico-thalamic projections.

L6 IT glutamatergic neurons: Primarily reside in Layer 6 and have mainly intratelencephalic (cortico-cortical) projections. Included in this subclass are L6 IT Car3 cells, which are highly similar to intracortical-projecting cells in the claustrum.

L6b glutamatergic neurons: Primarily reside in the neocortical subplate (L6b), with local (near the cell body) projections and some cortico-cortical projections from VISp to anterior cingulate, and cortico-subcortical projections to the thalamus.

CR glutamatergic neurons: A distinct subclass defined by a single type in L1, Cajal-Retzius cells express distinct molecular markers Lhx5 and Trp73.

Cerebellar Purkinje cells: large GABAergic neurons that are the only projection neurons and the sole output from the cerebellum. Their cell bodies form a single layer, so called 'Purkinje cell layer', and they express parvalbumin.

Deep cerebellar nucleus neurons: neurons located in the deep cerebellar nuclei structures. These include glutamatergic and GABAergic cells that express the gene Pvalb.

Non-neuronal Subclasses:

Astrocytes: Neuroectoderm-derived glial cells which express the marker Aqp4 and often GFAP, but do not express neuronal marker SNAP25. They can have a distinct star-shaped morphology and are involved in metabolic support of other cells in the brain. Multiple astrocyte morphologies are observed in mouse and human Oligodendrocytes: Neuroectoderm-derived glial cells, which express the marker Sox10. This category includes oligodendrocyte precursor cells (OPCs). Oligodendrocytes are the subclass that is primarily responsible for myelination of neurons.

VLMCs: Vascular leptomeningeal cells (VLMCs) are part of the meninges that surround the outer layer of the cortex and express the marker genes Lum and Col1a1.

Pericytes: Blood vessel-associated cells that express the marker genes Kcnj8 and Abcc9. Pericytes wrap around endothelial cells and are important for regulation of capillary blood flow and are involved in blood-brain barrier permeability.

SMCs: Specialized smooth-muscle cells which are blood vessel-associated cells that express the marker gene Acta2. SMCs cover arterioles in the brain and are involved in blood-brain barrier permeability.

Endothelial cells: Cells that line blood vessels of the brain. Endothelial cells express the markers Tek and PDGF-B.

Microglia: hematopoietic-derived immune cells, which are brain-resident macrophages, and perivascular macrophages (PVMs) that may be transitionally associated with brain tissue or included as a biproduct of brain dissection methods. Microglia are known to express Cx3cr1, Tmem119, and PTPRC (CD45).

In particular embodiments, a coding sequence is a heterologous coding sequence that encodes an effector element. An effector element is a sequence that is expressed to achieve, and that in fact achieves, an intended effect. Examples of effector elements include reporter genes/proteins and functional genes/proteins.

Exemplary reporter genes/proteins include those expressed by Addgene ID#s 83894 (pAAV-hDlx-Flex-dTomato-Fishell_7), 83895 (pAAV-hDlx-Flex-GFP-Fishell_6), 83896 (pAAV-hDlx-GiDREADD-dTomato-Fishell-5), 83898 (pAAV-mDlx-ChR2-mCherry-Fishell-3), 83899 (pAAV-mDlx-GCaMP6f-Fishell-2), 83900 (pAAV-mDlx-GFP-Fishell-1), and 89897 (pcDNA3-FLAG-mTET2 (N500)). Exemplary reporter genes particularly can include those which encode an expressible fluorescent protein, or expressible biotin; blue fluorescent proteins (e.g. eBFP, eBFP2, Azurite, mKalamal, GFPuv, Sapphire, T-sapphire); cyan fluorescent proteins (e.g. eCFP, Cerulean, CyPet, AmCyanl, Midoriishi-Cyan, mTurquoise); green fluorescent proteins (e.g. GFP, GFP-2, tagGFP, turboGFP, EGFP, Emerald, Azami Green, Monomeric Azami Green (mAzamigreen), CopGFP, AceGFP, avGFP, ZsGreenI, Oregon Green™ (Thermo Fisher Scientific)); Luciferase; orange fluorescent proteins (mOrange, mKO, Kusabira-Orange, Monomeric Kusabira-Orange, mTangerine, tdTomato, dTomato); red fluorescent proteins (mKate, mKate2, mPlum, DsRed monomer, mCherry, mRuby, mRFP1, DsRed-Express, DsRed2, DsRed-Monomer, HcRed-Tandem, HcRedl, AsRed2, eqFP611, mRaspberry, mStrawberry, Jred, Texas Red™ (Thermo Fisher Scientific)); far red fluorescent proteins (e.g., mPlum and mNeptune); yellow fluorescent proteins (e.g., YFP, eYFP, Citrine, SYFP2, Venus, YPet, PhiYFP, ZsYellowl); and tandem conjugates.

GFP is composed of 238 amino acids (26.9 kDa), originally isolated from the jellyfish *Aequorea victoria/Aequorea aequorea/Aequorea forskalea* that fluoresces green when exposed to blue light. The GFP from *A. victoria* has a major excitation peak at a wavelength of 395 nm and a minor one at 475 nm. Its emission peak is at 509 nm which is in the lower green portion of the visible spectrum. The GFP from the sea pansy (*Renilla reniformis*) has a single major excitation peak at 498 nm. Due to the potential for widespread usage and the evolving needs of researchers, many different mutants of GFP have been engineered. The first major improvement was a single point mutation (S65T) reported in 1995 in Nature by Roger Tsien. This mutation dramatically improved the spectral characteristics of GFP, resulting in increased fluorescence, photostability and a shift of the major excitation peak to 488 nm with the peak emission kept at 509 nm. The addition of the 37° C. folding efficiency (F64L) point mutant to this scaffold yielded enhanced GFP (EGFP). EGFP has an extinction coefficient (denoted c), also known as its optical cross section of 9.13×10-21 m²/molecule, also quoted as 55,000 L/(mol·cm). Superfolder GFP, a series of mutations that allow GFP to rapidly fold and mature even when fused to poorly folding peptides, was reported in 2006.

The "yellow fluorescent protein" (YFP) is a genetic mutant of green fluorescent protein, derived from *Aequorea victoria*. Its excitation peak is 514 nm and its emission peak is 527 nm.

Exemplary functional molecules include functioning ion transporters, cellular trafficking proteins, enzymes, transcription factors, neurotransmitters, calcium reporters, channelrhodopsins, guide RNA, nucleases, microRNA, or designer receptors exclusively activated by designer drugs (DREADDs).

Ion transporters are transmembrane proteins that mediate transport of ions across cell membranes. These transporters are pervasive throughout most cell types and important for regulating cellular excitability and homeostasis. Ion transporters participate in numerous cellular processes such as action potentials, synaptic transmission, hormone secretion, and muscle contraction. Many important biological processes in living cells involve the translocation of cations, such as calcium (Ca2+), potassium (K+), and sodium (Na+) ions, through such ion channels. In particular embodiments, ion transporters include voltage gated sodium channels (e.g., SCN1A), potassium channels (e.g., KCNQ2), and calcium channels (e.g. CACNA1C)).

Exemplary enzymes, transcription factors, receptors, membrane proteins, cellular trafficking proteins, signaling molecules, and neurotransmitters include enzymes such as lactase, lipase, helicase, alpha-glucosidase, amylase; transcription factors such as SP1, AP-1, Heat shock factor protein 1, C/EBP (CCAA-T/enhancer binding protein), and Oct-1; receptors such as transforming growth factor receptor beta 1, platelet-derived growth factor receptor, epidermal growth factor receptor, vascular endothelial growth factor receptor, and interleukin 8 receptor alpha; membrane proteins, cellular trafficking proteins such as clathrin, dynamin, caveolin, Rab-4A, and Rab-11A; signaling molecules such as nerve growth factor (NGF), platelet-derived growth factor (PDGF), transforming growth factor β (TGFβ), epidermal growth factor (EGF), GTPase and HRas; and neurotransmitters such as cocaine and amphetamine regulated transcript, substance P, oxytocin, and somatostatin.

In particular embodiments, functional molecules include reporters of cell function and states such as calcium reporters. Intracellular calcium concentration is an important predictor of numerous cellular activities, which include neuronal activation, muscle cell contraction and second messenger signaling. A sensitive and convenient technique to monitor the intracellular calcium levels is through the genetically encoded calcium indicator (GECI). Among the GECIs, green fluorescent protein (GFP) based calcium sensors named GCaMPs are efficient and widely used tools. The GCaMPs are formed by fusion of M13 and calmodulin protein to N- and C-termini of circularly permutated GFP. Some GCaMPs yield distinct fluorescence emission spectra (Zhao et al., Science, 2011, 333(6051): 1888-1891). Exemplary GECIs with green fluorescence include GCaMP3, GCaMP5G, GCaMP6s, GCaMP6m, GCaMP6f, jGCaMP7s, jGCaMP7c, jGCaMP7b, and jGCaMP7f. Furthermore, GECIs with red fluorescence include jRGECO1a and jRGECO1b. AAV products containing GECIs are commercially available. For example, Vigene Biosciences provides AAV products including AAV8-CAG-GCaMP3 (Cat. No:BS4-CX3AAV8), AAV8-Syn-FLEX-GCaMP6s-WPRE (Cat. No:BS1-NXSAAV8), AAV8-Syn-FLEX-GCaMP6s-WPRE (Cat. No:BS1-NXSAAV8), AAV9-CAG-FLEX- GCaMP6m-WPRE (Cat. No:BS2-CXMAAV9), AAV9-Syn-FLEX-jGCaMP7s-WPRE (Cat. No:BS12-NXSAAV9), AAV9-CAG-FLEX-jGCaMP7f-WPRE (Cat. No:BS12-CXFAAV9), AAV9-Syn-FLEX-jGCaMP7b-WPRE (Cat. No:BS12-NXBAAV9), AAV9-Syn-FLEX-jGCaMP7c-WPRE (Cat. No: BS12-NXCAAV9), AAV9-Syn-FLEX-NES-jRGECO1a-WPRE (Cat. No:B58-NXAAAV9), and AAV8-Syn-FLEX-NES-jRCaMP1b-WPRE (Cat. No:BS7-NXBAAV8).

In particular embodiments calcium reporters include the genetically encoded calcium indicators GECI, NTnC; Myosin light chain kinase, GFP, Calmodulin chimera; Calcium indicator TN-XXL; BRET-based auto-luminescent calcium indicator; and/or Calcium indicator protein OeNL(Ca2+)-18u).

In particular embodiments, functional molecules include modulators of neuronal activity like channelrhodopsins (e.g., channelrhodopsin-1, channelrhodopsin-2, and variants thereof). Channelrhodopsins are a subfamily of retinylidene proteins (rhodopsins) that function as light-gated ion channels. In addition to channelrhodopsin 1 (ChR1) and channelrhodopsin 2 (ChR2), several variants of channelrhodopsins have been developed. For example, Lin et al. (Biophys J, 2009, 96(5): 1803-14) describe making chimeras of the transmembrane domains of ChR1 and ChR2, combined with site-directed mutagenesis. Zhang et al. (Nat Neurosci, 2008, 11(6): 631-3) describe VChR1, which is a red-shifted channelrhodopsin variant. VChR1 has lower light sensitivity and poor membrane trafficking and expression. Other known channelrhodopsin variants include the ChR2 variant described in Nagel, et al., Proc Natl Acad Sci USA, 2003, 100(24): 13940-5), ChR2/H134R (Nagel, G., et al., Curr Biol, 2005, 15(24): 2279-84), and ChD/ChEF/ChIEF (Lin, J. Y., et al., Biophys J, 2009, 96(5): 1803-14), which are activated by blue light (470 nm) but show no sensitivity to orange/red light. Additional variants are described in Lin, Experimental Physiology, 2010, 96.1: 19-25 and Knopfel et al., The Journal of Neuroscience, 2010, 30(45): 14998-15004).

In particular embodiments, functional molecules include DNA and RNA editing tools such CRISPR/CAS (e.g., guide RNA and a nuclease, such as Cas, Cas9 or cpf1). Functional molecules can also include engineered Cpf1s such as those described in US 2018/0030425, US 2016/0208243, WO/2017/184768 and Zetsche et al. (2015) Cell 163: 759-771; single gRNA (see e.g., Jinek et al. (2012) Science 337:816-821; Jinek et al. (2013) eLife 2:e00471; Segal (2013) eLife 2:e00563) or editase, guide RNA molecules, microRNA, or homologous recombination donor cassettes.

Sequences are publicly-available. As examples, lactase (e.g., GenBank: EAX11622.1), lipase (e.g., GenBank: AAA60129.1), helicase (e.g., GenBank: AMD82207.1), amylase (e.g., GenBank: AAA51724.1), alpha-glucosidase (e.g., GenBank: ABI53718.1), transcription factor SP1 (e.g., UniProtKB/Swiss-Prot: P08047.3), transcription factor AP-1 (e.g., NP_002219.1), heat shock factor protein 1 (e.g., UniProtKB/Swiss-Prot: Q00613.1), CCAAT/enhancer-binding protein (C/EBP) beta isoform a (e.g., NP_005185.2), Oct-1 (e.g., UniProtKB/Swiss-Prot: P14859.2), TGFβ. (e.g., GenBank: CAF02096.2), platelet-derived growth factor receptor (e.g., GenBank: AAA60049.1), epidermal growth factor receptor (e.g., GenBank: CAA25240.1), vascular endothelial growth factor receptor (e.g., GenBank: AAC16449.2), interleukin 8 receptor alpha (e.g., GenBank: AAB59436.1), caveolin (e.g., GenBank: CAA79476.1), dynamin (e.g., GenBank: AAA88025.1), clathrin heavy chain 1 isoform 1 (e.g., NP_004850.1), clathrin heavy chain 2 isoform 1 (e.g., NP_009029.3), clathrin light chain A isoform a (e.g., NP_001824.1), clathrin light chain B isoform a (e.g., NP_001825.1), ras-related protein Rab-4A isoform 1 (e.g., NP_004569.2), ras-related protein Rab-11A (e.g., UniProtKB/Swiss-Prot: P62491.3), platelet-derived growth factor (e.g., GenBank: AAA60552.1), transforming growth factor-beta3 (e.g., GenBank: AAA61161.1), nerve growth factor (e.g., GenBank: CAA37703.1), EGF (e.g., GenBank: CAA34902.2), cocaine and amphetamine regulated transcript (Chain A) (e.g., PDB: 1HY9_A), protachykinin-1 (e.g., UniProtKB—P20366), oxytocin-neurophysin 1 (e.g., UniProtKB—P01178), somatostatin (e.g., GenBank: AAH32625.1), genetically-encoded green calcium indicator NTnC (chain A) [synthetic construct] (e.g., PDB: 5MWC_A), calcium indicator TN-XXL [synthetic construct], (e.g., GenBank: ACF93133.1), BRET-based auto-luminescent calcium indicator [synthetic construct] (e.g., GenBank ADF42668.1), calcium indicator protein OeNL (Ca2+)-18u [synthetic construct], ((e.g., GenBank BBB18812.1), myosin light chain kinase, Green fluorescent protein, Calmodulin chimera (Chain A) [synthetic construct] ((e.g., PDB: 3EKJ_A), channelopsin 1 (e.g., UniProtKB—F8UV15), channelopsin 1 (e.g., GenBank: AER58217.1), channelrhodopsin-2 ((e.g., UniProtKB—B4Y105), channel rhodopsin 2 [synthetic construct] ((e.g., GenBank: AB064386.1), CRISPR-associated protein (Cas) (e.g., GenBank: AKG27598.1), Cas9 [synthetic construct] (e.g., GenBank: AST09977.1), CRISPR-associated endonuclease Cpf1 (e.g., UniProtKB/Swiss-Prot: U2UMQ6.1), ribonuclease 4 or ribonuclease L (e.g., UniProtKB/Swiss-Prot: Q05823.2), deoxyribonuclease 11 beta (e.g., GenBank: AAF76893.1), sodium channel protein type 1 subunit alpha (e.g., UniProtKB—P35498), potassium voltage-gated channel subfamily KQT member 2 (e.g., UniProtKB—O43526), and voltage-dependent L-type calcium channel subunit alpha-1C (e.g., UniProtKB—Q13936).

Additional effector elements include Cre, iCre, dgCre, FlpO, and tTA2. iCre refers to a codon-improved Cre. dgCre refers to an enhanced GFP/Cre recombinase fusion gene with an N terminal fusion of the first 159 amino acids of the *Escherichia coli* K-12 strain chromosomal dihydrofolate reductase gene (DHFR or folA) harboring a G67S mutation and modified to also include the R12Y/Y1001 destabilizing domain mutation. FlpO refers to a codon-optimized form of FLPe that greatly increases protein expression and FRT recombination efficiency in mouse cells. Like the Cre/LoxP system, the FLP/FRT system has been widely used for gene expression (and generating conditional knockout mice, mediated by the FLP/FRT system). tTA2 refers to tetracycline transactivator.

Exemplary expressible elements are expression products that do not include effector elements, for example, a non-functioning or defective protein. In particular embodiments, expressible elements can provide methods to study the effects of their functioning counterparts. In particular embodiments, expressible elements are non-functioning or defective based on an engineered mutation that renders them non-functioning. In these aspects, non-expressible elements are as similar in structure as possible to their functioning counterparts.

Exemplary self-cleaving peptides include the 2A peptides which lead to the production of two proteins from one mRNA. The 2A sequences are short (e.g., 20 amino acids), allowing more use in size-limited constructs. Particular examples include P2A, T2A, E2A, and F2A. In particular embodiments, the artificial expression constructs include an internal ribosome entry site (IRES) sequence. IRES allow ribosomes to initiate translation at a second internal site on a mRNA molecule, leading to production of two proteins from one mRNA.

Coding sequences encoding molecules (e.g., RNA, proteins) described herein can be obtained from publicly available databases and publications. Coding sequences can further include various sequence polymorphisms, mutations, and/or sequence variants wherein such alterations do not affect the function of the encoded molecule. The term "encode" or "encoding" refers to a property of sequences of nucleic acids, such as a vector, a plasmid, a gene, cDNA, mRNA, to serve as templates for synthesis of other molecules such as proteins.

The term "gene" may include not only coding sequences but also regulatory regions such as promoters, enhancers, insulators, and/or post-regulatory elements, such as termination regions. The term further can include all introns and other DNA sequences spliced from the mRNA transcript, along with variants resulting from alternative splice sites. The sequences can also include degenerate codons of a reference sequence or sequences that may be introduced to provide codon preference in a specific organism or cell type.

Promoters can include general promoters, tissue-specific promoters, cell-specific promoters, and/or promoters specific for the cytoplasm. Promoters may include strong promoters, weak promoters, constitutive expression promoters, and/or inducible promoters. Inducible promoters direct expression in response to certain conditions, signals or cellular events. For example, the promoter may be an inducible promoter that requires a particular ligand, small molecule, transcription factor or hormone protein in order to effect transcription from the promoter. Particular examples of promoters include minBglobin, CMV, minCMV, minCMV* (minCMV* is minCMV with a SacI restriction site removed), minRho, minRho* (minRho* is minRho with a SacI restriction site removed), SV40 immediately early promoter, the Hsp68 minimal promoter (proHSP68), and the Rous Sarcoma Virus (RSV) long-terminal repeat (LTR) promoter. Minimal promoters have no activity to drive gene expression on their own but can be activated to drive gene expression when linked to a proximal enhancer element.

In particular embodiments, expression constructs are provided within vectors. The term vector refers to a nucleic acid molecule capable of transferring or transporting another nucleic acid molecule, such as an artificial expression construct. The transferred nucleic acid is generally linked to, e.g., inserted into, the vector nucleic acid molecule. A vector may include sequences that direct autonomous replication in a cell or may include sequences that permit integration into host cell DNA. Useful vectors include, for example, plasmids (e.g., DNA plasmids or RNA plasmids), transposons, cosmids, bacterial artificial chromosomes, and viral vectors.

Viral vector is widely used to refer to a nucleic acid molecule that includes virus-derived components that facilitate transfer and expression of non-native nucleic acid molecules within a cell. The term adeno-associated viral vector refers to a viral vector or plasmid containing structural and functional genetic elements, or portions thereof, that are primarily derived from AAV. The term "retroviral vector" refers to a viral vector or plasmid containing structural and functional genetic elements, or portions thereof, that are primarily derived from a retrovirus. The term "lentiviral vector" refers to a viral vector or plasmid containing structural and functional genetic elements, or portions thereof, that are primarily derived from a lentivirus, and so on. The term "hybrid vector" refers to a vector including structural and/or functional genetic elements from more than one virus type.

Adenovirus vectors refer to those constructs containing adenovirus sequences sufficient to (a) support packaging of an artificial expression construct and (b) to express a coding sequence that has been cloned therein in a sense or antisense orientation. A recombinant Adenovirus vector includes a genetically engineered form of an adenovirus. Knowledge of the genetic organization of adenovirus, a 36 kb, linear, double-stranded DNA virus, allows substitution of large pieces of adenoviral DNA with foreign sequences up to 7 kb. In contrast to retrovirus, the adenoviral infection of host cells does not result in chromosomal integration because adenoviral DNA can replicate in an episomal manner without potential genotoxicity. Also, adenoviruses are structurally stable, and no genome rearrangement has been detected after extensive amplification.

Adenovirus is particularly suitable for use as a gene transfer vector because of its mid-sized genome, ease of manipulation, high titer, wide target-cell range, and high infectivity. Both ends of the viral genome contain 100-200 base pair inverted repeats (ITRs), which are cis elements necessary for viral DNA replication and packaging. The early (E) and late (L) regions of the genome contain different transcription units that are divided by the onset of viral DNA replication. The E1 region (E1A and E1B) encodes proteins responsible for the regulation of transcription of the viral genome and a few cellular genes. The expression of the E2 region (E2A and E2B) results in the synthesis of the proteins for viral DNA replication. These proteins are involved in DNA replication, late gene expression, and host cell shut-off. The products of the late genes, including the majority of the viral capsid proteins, are expressed only after significant processing of a single primary transcript issued by the major late promoter (MLP). The MLP is particularly efficient during the late phase of infection, and all the mRNAs issued from this promoter possess a 5'-tripartite leader (TPL) sequence which makes them preferred mRNAs for translation.

Other than the requirement that an adenovirus vector be replication defective, or at least conditionally defective, the nature of the adenovirus vector is not believed to be crucial to the successful practice of particular embodiments disclosed herein. The adenovirus may be of any of the 42 different known serotypes or subgroups A-F. In particular embodiments, adenovirus type 5 of subgroup C is the preferred starting material in order to obtain a conditional replication-defective adenovirus vector for use in particular embodiments, since Adenovirus type 5 is a human adenovirus about which a great deal of biochemical and genetic information is known, and it has historically been used for most constructions employing adenovirus as a vector.

As indicated, the typical vector is replication defective and will not have an adenovirus E1 region. Thus, it will be most convenient to introduce the polynucleotide encoding the gene of interest at the position from which the E1-coding sequences have been removed. However, the position of insertion of the construct within the adenovirus sequences is not critical. The polynucleotide encoding the gene of interest may also be inserted in lieu of a deleted E3 region in E3 replacement vectors or in the E4 region where a helper cell line or helper virus complements the E4 defect.

Adeno-Associated Virus (AAV) is a parvovirus, discovered as a contamination of adenoviral stocks. It is a ubiquitous virus (antibodies are present in 85% of the US human population) that has not been linked to any disease. It is also classified as a dependovirus, because its replication is dependent on the presence of a helper virus, such as adenovirus. Various serotypes have been isolated, of which AAV-2 is the best characterized. AAV has a single-stranded linear DNA that is encapsidated into capsid proteins VP1, VP2 and VP3 to form an icosahedral virion of 20 to 24 nm in diameter.

The AAV DNA is 4.7 kilobases long. It contains two open reading frames and is flanked by two ITRs. There are two major genes in the AAV genome: rep and cap. The rep gene codes for proteins responsible for viral replications, whereas cap codes for capsid protein VP1-3. Each ITR forms a T-shaped hairpin structure. These terminal repeats are the only essential cis components of the AAV for chromosomal integration. Therefore, the AAV can be used as a vector with all viral coding sequences removed and replaced by the cassette of genes for delivery. Three AAV viral promoters have been identified and named p5, p19, and p40, according to their map position. Transcription from p5 and p19 results in production of rep proteins, and transcription from p40 produces the capsid proteins.

AAVs stand out for use within the current disclosure because of their superb safety profile and because their capsids and genomes can be tailored to allow expression in selected cell populations. scAAV refers to a self-complementary AAV. pAAV refers to a plasmid adeno-associated virus. rAAV refers to a recombinant adeno-associated virus.

Other viral vectors may also be employed. For example, vectors derived from viruses such as vaccinia virus, polioviruses and herpes viruses may be employed. They offer several attractive features for various mammalian cells.

Retroviruses are a common tool for gene delivery. "Retrovirus" refers to an RNA virus that reverse transcribes its genomic RNA into a linear double-stranded DNA copy and subsequently covalently integrates its genomic DNA into a host genome. Once the virus is integrated into the host genome, it is referred to as a "provirus." The provirus serves as a template for RNA polymerase II and directs the expression of RNA molecules which encode the structural proteins and enzymes needed to produce new viral particles.

Illustrative retroviruses suitable for use in particular embodiments, include: Moloney murine leukemia virus (M-MuLV), Moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV), Rous Sarcoma Virus (RSV), and lentivirus.

"Lentivirus" refers to a group (or genus) of complex retroviruses. Illustrative lentiviruses include: HIV (human immunodeficiency virus; including HIV type 1, and HIV type 2); visna-maedi virus (VMV); the caprine arthritis-encephalitis virus (CAEV); equine infectious anemia virus (EIAV); feline immunodeficiency virus (FIV); bovine immune deficiency virus (BIV); and simian immunodeficiency virus (SIV). In particular embodiments, HIV based vector backbones (i.e., HIV cis-acting sequence elements) can be used.

A safety enhancement for the use of some vectors can be provided by replacing the U3 region of the 5' LTR with a heterologous promoter to drive transcription of the viral genome during production of viral particles. Examples of heterologous promoters which can be used for this purpose include, for example, viral simian virus 40 (SV40) (e.g., early or late), cytomegalovirus (CMV) (e.g., immediate early), Moloney murine leukemia virus (MoMLV), Rous sarcoma virus (RSV), and herpes simplex virus (HSV)

(thymidine kinase) promoters. Typical promoters are able to drive high levels of transcription in a Tat-independent manner. This replacement reduces the possibility of recombination to generate replication-competent virus because there is no complete U3 sequence in the virus production system. In particular embodiments, the heterologous promoter has additional advantages in controlling the manner in which the viral genome is transcribed. For example, the heterologous promoter can be inducible, such that transcription of all or part of the viral genome will occur only when the induction factors are present. Induction factors include one or more chemical compounds or the physiological conditions such as temperature or pH, in which the host cells are cultured.

In particular embodiments, viral vectors include a TAR element. The term "TAR" refers to the "trans-activation response" genetic element located in the R region of lentiviral LTRs. This element interacts with the lentiviral transactivator (tat) genetic element to enhance viral replication. However, this element is not required in embodiments wherein the U3 region of the 5' LTR is replaced by a heterologous promoter.

The "R region" refers to the region within retroviral LTRs beginning at the start of the capping group (i.e., the start of transcription) and ending immediately prior to the start of the poly(A) tract. The R region is also defined as being flanked by the U3 and U5 regions. The R region plays a role during reverse transcription in permitting the transfer of nascent DNA from one end of the genome to the other.

In particular embodiments, expression of heterologous sequences in viral vectors is increased by incorporating posttranscriptional regulatory elements, efficient polyadenylation sites, and optionally, transcription termination signals into the vectors. A variety of posttranscriptional regulatory elements can increase expression of a heterologous nucleic acid. Examples include the woodchuck hepatitis virus posttranscriptional regulatory element (WPRE; Zufferey et al., 1999, J. Virol., 73:2886); the posttranscriptional regulatory element present in hepatitis B virus (HPRE) (Smith et al., Nucleic Acids Res. 26(21):4818-4827, 1998); and the like (Liu et al., 1995, Genes Dev., 9:1766). In particular embodiments, vectors include a posttranscriptional regulatory element such as a WPRE or HPRE. In particular embodiments, vectors lack or do not include a posttranscriptional regulatory element such as a WPRE or HPRE.

Elements directing the efficient termination and polyadenylation of a heterologous nucleic acid transcript can increase heterologous gene expression. Transcription termination signals are generally found downstream of the polyadenylation signal. In particular embodiments, vectors include a polyadenylation signal 3' of a polynucleotide encoding a molecule (e.g., protein) to be expressed. The term "poly(A) site" or "poly(A) sequence" denotes a DNA sequence which directs both the termination and polyadenylation of the nascent RNA transcript by RNA polymerase II. Polyadenylation sequences can promote mRNA stability by addition of a poly(A) tail to the 3' end of the coding sequence and thus, contribute to increased translational efficiency. Particular embodiments may utilize BGHpA or SV40pA. In particular embodiments, a preferred embodiment of an artificial expression construct includes a terminator element. These elements can serve to enhance transcript levels and to minimize read through from the construct into other plasmid sequences.

In particular embodiments, a viral vector further includes one or more insulator elements. Insulators elements may contribute to protecting viral vector-expressed sequences, e.g., effector elements or expressible elements, from integration site effects, which may be mediated by cis-acting elements present in genomic DNA and lead to deregulated expression of transferred sequences (i.e., position effect; see, e.g., Burgess-Beusse et al., PNAS., USA, 99:16433, 2002; and Zhan et al., Hum. Genet., 109:471, 2001). In particular embodiments, viral transfer vectors include one or more insulator elements at the 3' LTR and upon integration of the provirus into the host genome, the provirus includes the one or more insulators at both the 5' LTR and 3' LTR, by virtue of duplicating the 3' LTR. Suitable insulators for use in particular embodiments include the chicken β-globin insulator (see Chung et al., Cell 74:505, 1993; Chung et al., PNAS USA 94:575, 1997; and Bell et al., Cell 98:387, 1999), SP10 insulator (Abhyankar et al., JBC 282:36143, 2007), or other small CTCF recognition sequences that function as enhancer blocking insulators (Liu et al., Nature Biotechnology, 33:198, 2015).

Beyond the foregoing description, a wide range of suitable expression vector types will be known to a person of ordinary skill in the art. These can include commercially available expression vectors designed for general recombinant procedures, for example plasmids that contain one or more reporter genes and regulatory elements required for expression of the reporter gene in cells. Numerous vectors are commercially available, e.g., from Invitrogen, Stratagene, Clontech, etc., and are described in numerous associated guides. In particular embodiments, suitable expression vectors include any plasmid, cosmid or phage construct that is capable of supporting expression of encoded genes in mammalian cell, such as pUC or Bluescript plasmid series.

Particular embodiments of vectors disclosed herein include:

| Vector ID | Sequence Name |
| --- | --- |
| CN2084 | rAAV-eHGT_373m-minBglobin-SYFP2-WPRE3-BGHpA |
| CN2085 | rAAV-eHGT_375m-minBglobin-SYFP2-WPRE3-BGHpA |
| CN2086 | rAAV-eHGT_379m-minBglobin-SYFP2-WPRE3-BGHpA |
| CN2083 | rAAV-eHGT_372m-minBglobin-SYFP2-WPRE3-BGHpA |
| CN2087 | rAAV-eHGT_384m-minBglobin-SYFP2-WPRE3-BGHpA |
| CN2088 | rAAV-eHGT_386m-minBglobin-SYFP2-WPRE3-BGHpA |
| CN2089 | rAAV-eHGT_390m-minBglobin-SYFP2-WPRE3-BGHpA |
| CN2082 | rAAV-eHGT_371m-minBglobin-SYFP2-WPRE3-BGHpA |
| CN2090 | rAAV-eHGT_391m-minBglobin-SYFP2-WPRE3-BGHpA |
| CN2091 | rAAV-eHGT_398m-minBglobin-SYFP2-WPRE3-BGHpA |
| CN2092 | rAAV-eHGT_402m-minBglobin-SYFP2-WPRE3-BGHpA |
| CN2093 | rAAV-eHGT_409m-minBglobin-SYFP2-WPRE3-BGHpA |
| CN2094 | rAAV-eHGT_413m-minBglobin-SYFP2-WPRE3-BGHpA |
| CN2095 | rAAV-eHGT_414m-minBglobin-SYFP2-WPRE3-BGHpA |
| CN2096 | rAAV-eHGT_415m-minBglobin-SYFP2-WPRE3-BGHpA |
| CN2097 | rAAV-eHGT_383m-minBglobin-SYFP2-WPRE3-BGHpA |
| CN2098 | rAAV-eHGT_374m-minBglobin-SYFP2-WPRE3-BGHpA |
| CN2099 | rAAV-eHGT_396m-minBglobin-SYFP2-WPRE3-BGHpA |
| CN2100 | rAAV-eHGT_381m-minBglobin-SYFP2-WPRE3-BGHpA |
| CN2101 | rAAV-eHGT_382m-minBglobin-SYFP2-WPRE3-BGHpA |
| CN2102 | rAAV-eHGT_387m-minBglobin-SYFP2-WPRE3-BGHpA |
| CN2103 | rAAV-eHGT_388m-minBglobin-SYFP2-WPRE3-BGHpA |
| CN2104 | rAAV-eHGT_393m-minBglobin-SYFP2-WPRE3-BGHpA |
| CN2105 | rAAV-eHGT_399m-minBglobin-SYFP2-WPRE3-BGHpA |
| CN2106 | rAAV-eHGT_400m-minBglobin-SYFP2-WPRE3-BGHpA |
| CN2107 | rAAV-eHGT_405m-minBglobin-SYFP2-WPRE3-BGHpA |
| CN2108 | rAAV-eHGT_406m-minBglobin-SYFP2-WPRE3-BGHpA |
| CN2109 | rAAV-eHGT_410m-minBglobin-SYFP2-WPRE3-BGHpA |
| CN2110 | rAAV-eHGT_416m-minBglobin-SYFP2-WPRE3-BGHpA |
| CN2111 | rAAV-eHGT_417m-minBglobin-SYFP2-WPRE3-BGHpA |
| CN2112 | rAAV-eHGT_418m-minBglobin-SYFP2-WPRE3-BGHpA |
| CN2113 | rAAV-eHGT_419m-minBglobin-SYFP2-WPRE3-BGHpA |
| CN2114 | rAAV-eHGT_420m-minBglobin-SYFP2-WPRE3-BGHpA |
| CN2115 | rAAV-eHGT_421m-minBglobin-SYFP2-WPRE3-BGHpA |
| CN2116 | rAAV-eHGT_423m-minBglobin-SYFP2-WPRE3-BGHpA |
| CN2117 | rAAV-eHGT_428m-minBglobin-SYFP2-WPRE3-BGHpA |
| CN2118 | rAAV-eHGT_429m-minBglobin-SYFP2-WPRE3-BGHpA |
| CN2119 | rAAV-eHGT_430m-minBglobin-SYFP2-WPRE3-BGHpA |
| CN2120 | rAAV-eHGT_376m-minBglobin-SYFP2-WPRE3-BGHpA |
| CN2121 | rAAV-eHGT_380m-minBglobin-SYFP2-WPRE3-BGHpA |
| CN2122 | rAAV-eHGT_385m-minBglobin-SYFP2-WPRE3-BGHpA |
| CN2123 | rAAV-eHGT_397m-minBglobin-SYFP2-WPRE3-BGHpA |
| CN2124 | rAAV-eHGT_401m-minBglobin-SYFP2-WPRE3-BGHpA |
| CN2125 | rAAV-eHGT_403m-minBglobin-SYFP2-WPRE3-BGHpA |
| CN2126 | rAAV-eHGT_407m-minBglobin-SYFP2-WPRE3-BGHpA |
| CN2127 | rAAV-eHGT_408m-minBglobin-SYFP2-WPRE3-BGHpA |
| CN2128 | rAAV-eHGT_411m-minBglobin-SYFP2-WPRE3-BGHpA |
| CN2129 | rAAV-eHGT_412m-minBglobin-SYFP2-WPRE3-BGHpA |
| CN2130 | rAAV-eHGT_422m-minBglobin-SYFP2-WPRE3-BGHpA |
| CN2131 | rAAV-eHGT_424m-minBglobin-SYFP2-WPRE3-BGHpA |
| CN2132 | rAAV-eHGT_425m-minBglobin-SYFP2-WPRE3-BGHpA |
| CN2133 | rAAV-eHGT_426m-minBglobin-SYFP2-WPRE3-BGHpA |
| CN2134 | rAAV-eHGT_427m-minBglobin-SYFP2-WPRE3-BGHpA |
| CN2141 | rAAV-eHGT_371h-minBglobin-SYFP2-WPRE3-BGHpA |
| CN2142 | rAAV-eHGT_372h-minBglobin-SYFP2-WPRE3-BGHpA |
| CN2143 | rAAV-eHGT_375h-minBglobin-SYFP2-WPRE3-BGHpA |
| CN2144 | rAAV-eHGT_376h-minBglobin-SYFP2-WPRE3-BGHpA |

-continued

| Vector ID | Sequence Name |
|---|---|
| CN2145 | rAAV-eHGT_377h-minBglobin-SYFP2-WPRE3-BGHpA |
| CN2146 | rAAV-eHGT_381h-minBglobin-SYFP2-WPRE3-BGHpA |
| CN2147 | rAAV-eHGT_382h-minBglobin-SYFP2-WPRE3-BGHpA |
| CN2148 | rAAV-eHGT_383h-minBglobin-SYFP2-WPRE3-BGHpA |
| CN2149 | rAAV-eHGT_384h-minBglobin-SYFP2-WPRE3-BGHpA |
| CN2150 | rAAV-eHGT_387h-minBglobin-SYFP2-WPRE3-BGHpA |
| CN2151 | rAAV-eHGT_388h-minBglobin-SYFP2-WPRE3-BGHpA |
| CN2152 | rAAV-eHGT_389h-minBglobin-SYFP2-WPRE3-BGHpA |
| CN2153 | rAAV-eHGT_390h-minBglobin-SYFP2-WPRE3-BGHpA |
| CN2154 | rAAV-eHGT_392h-minBglobin-SYFP2-WPRE3-BGHpA |
| CN2155 | rAAV-eHGT_393h-minBglobin-SYFP2-WPRE3-BGHpA |
| CN2156 | rAAV-eHGT_394h-minBglobin-SYFP2-WPRE3-BGHpA |
| CN2157 | rAAV-eHGT_395h-minBglobin-SYFP2-WPRE3-BGHpA |
| CN2158 | rAAV-eHGT_396h-minBglobin-SYFP2-WPRE3-BGHpA |
| CN2159 | rAAV-eHGT_397h-minBglobin-SYFP2-WPRE3-BGHpA |
| CN2160 | rAAV-eHGT_398h-minBglobin-SYFP2-WPRE3-BGHpA |
| CN2161 | rAAV-eHGT_399h-minBglobin-SYFP2-WPRE3-BGHpA |
| CN2162 | rAAV-eHGT_400h-minBglobin-SYFP2-WPRE3-BGHpA |
| CN2163 | rAAV-eHGT_402h-minBglobin-SYFP2-WPRE3-BGHpA |
| CN2164 | rAAV-eHGT_404h-minBglobin-SYFP2-WPRE3-BGHpA |
| CN2165 | rAAV-eHGT_405h-minBglobin-SYFP2-WPRE3-BGHpA |
| CN2166 | rAAV-eHGT_406h-minBglobin-SYFP2-WPRE3-BGHpA |
| CN2167 | rAAV-eHGT_407h-minBglobin-SYFP2-WPRE3-BGHpA |
| CN2168 | rAAV-eHGT_408h-minBglobin-SYFP2-WPRE3-BGHpA |
| CN2169 | rAAV-eHGT_411h-minBglobin-SYFP2-WPRE3-BGHpA |
| CN2170 | rAAV-eHGT_412h-minBglobin-SYFP2-WPRE3-BGHpA |
| CN2171 | rAAV-eHGT_413h-minBglobin-SYFP2-WPRE3-BGHpA |
| CN2172 | rAAV-eHGT_414h-minBglobin-SYFP2-WPRE3-BGHpA |
| CN2173 | rAAV-eHGT_417h-minBglobin-SYFP2-WPRE3-BGHpA |
| CN2174 | rAAV-eHGT_418h-minBglobin-SYFP2-WPRE3-BGHpA |
| CN2175 | rAAV-eHGT_419h-minBglobin-SYFP2-WPRE3-BGHpA |
| CN2176 | rAAV-eHGT_420h-minBglobin-SYFP2-WPRE3-BGHpA |
| CN2177 | rAAV-eHGT_423h-minBglobin-SYFP2-WPRE3-BGHpA |
| CN2178 | rAAV-eHGT_424h-minBglobin-SYFP2-WPRE3-BGHpA |
| CN2179 | rAAV-eHGT_425h-minBglobin-SYFP2-WPRE3-BGHpA |
| CN2180 | rAAV-eHGT_426h-minBglobin-SYFP2-WPRE3-BGHpA |
| CN2181 | rAAV-eHGT_427h-minBglobin-SYFP2-WPRE3-BGHpA |
| CN2182 | rAAV-eHGT_428h-minBglobin-SYFP2-WPRE3-BGHpA |
| CN2183 | rAAV-eHGT_429h-minBglobin-SYFP2-WPRE3-BGHpA |
| CN2184 | rAAV-eHGT_430h-minBglobin-SYFP2-WPRE3-BGHpA |
| CN1781 | rAAV-hsA2-eHGT_267h-minRho-SYFP2-WPRE3-BGHpA |
| CN1782 | rAAV-hsA2-eHGT_268h-minRho-SYFP2-WPRE3-BGHpA |
| CN1783 | rAAV-hsA2-eHGT_269h-minRho-SYFP2-WPRE3-BGHpA |
| CN1784 | rAAV-hsA2-eHGT_270h-minRho-SYFP2-WPRE3-BGHpA |
| CN1785 | rAAV-hsA2-eHGT_271h-minRho-SYFP2-WPRE3-BGHpA |
| CN1786 | rAAV-hsA2-eHGT_272h-minRho-SYFP2-WPRE3-BGHpA |
| CN1787 | rAAV-hsA2-eHGT_273h-minRho-SYFP2-WPRE3-BGHpA |
| CN1788 | rAAV-hsA2-eHGT_274h-minRho-SYFP2-WPRE3-BGHpA |
| CN1789 | rAAV-hsA2-eHGT_275h-minRho-SYFP2-WPRE3-BGHpA |
| CN1790 | rAAV-hsA2-eHGT_276h-minRho-SYFP2-WPRE3-BGHpA |
| CN2345 | rAAV-eHGT_315h-minBglobin-SYFP2-WPRE3-BGHpA |
| CN2346 | rAAV-eHGT_316h-minBglobin-SYFP2-WPRE3-BGHpA |
| CN2044 | rAAV-3xSP10ins-eHGT_357h-minRho*-SYFP2-WPRE3-BGHpA |
| CN2268 | rAAV-eHGT_495m-minBglobin-SYFP2-WPRE3-BGHpA |
| CN2243 | rAAV-eHGT_497m-minBglobin-SYFP2-WPRE3-BGHpA |
| CN2845 | rAAV-eHGT_641m-minBglobin-SYFP2-WPRE3-BGHpA |
| CN2556 | rAAV-3xCore_eHGT_410m-minBglobin-SYFP2-WPRE3-BGHpA |
| CN2558 | rAAV-3xCore2_eHGT_390m-minBglobin-SYFP2-WPRE3-BGHpA |
| CN2560 | rAAV-3xCore_eHGT_373m-minBglobin-SYFP2-WPRE3-BGHpA |
| 3001 | rAAV-mscRE1001-minBGlobin-FlpO-WPRE-BGHpA |
| 3002 | rAAV-mscRE1002-minBGlobin-FlpO-WPRE-BGHpA |
| 3003 | rAAV-mscRE1003-minBGlobin-FlpO-WPRE-BGHpA |
| 3004 | rAAV-mscRE1004-minBGlobin-FlpO-WPRE-BGHpA |
| 3005 | rAAV-mscRE1005-minBGlobin-FlpO-WPRE-BGHpA |
| 3006 | rAAV-mscRE1006-minBGlobin-FlpO-WPRE-BGHpA |
| 3007 | rAAV-mscRE1007-minBGlobin-FlpO-WPRE-BGHpA |
| 3008 | rAAV-mscRE1008-minBGlobin-FlpO-WPRE-BGHpA |
| 3009 | rAAV-mscRE1009-minBGlobin-FlpO-WPRE-BGHpA |
| 3010 | rAAV-mscRE1010-minBGlobin-FlpO-WPRE-BGHpA |
| 3011 | rAAV-mscRE1011-minBGlobin-FlpO-WPRE-BGHpA |
| 3012 | rAAV-mscRE1012-minBGlobin-FlpO-WPRE-BGHpA |
| 3013 | rAAV-mscRE1013-minBGlobin-FlpO-WPRE-BGHpA |
| 3014 | rAAV-mscRE1014-minBGlobin-FlpO-WPRE-BGHpA |
| 3015 | rAAV-mscRE1015-minBGlobin-FlpO-WPRE-BGHpA |
| 3016 | rAAV-mscRE1016-minBGlobin-FlpO-WPRE-BGHpA |
| 3017 | rAAV-mscRE1017-minBGlobin-FlpO-WPRE-BGHpA |
| 3018 | rAAV-mscRE1018-minBGlobin-FlpO-WPRE-BGHpA |

-continued

| Vector ID | Sequence Name |
|-----------|---------------|
| 3019 | rAAV-mscRE1019-minBGlobin-FlpO-WPRE-BGHpA |
| 3020 | rAAV-mscRE1020-minBGlobin-FlpO-WPRE-BGHpA |
| 3021 | rAAV-mscRE1021-minBGlobin-FlpO-WPRE-BGHpA |
| 3022 | rAAV-mscRE1022-minBGlobin-FlpO-WPRE-BGHpA |
| 3023 | rAAV-mscRE1023-minBGlobin-FlpO-WPRE-BGHpA |
| 3024 | rAAV-mscRE1024-minBGlobin-FlpO-WPRE-BGHpA |
| 3025 | rAAV-mscRE1025-minBGlobin-FlpO-WPRE-BGHpA |
| 3026 | rAAV-mscRE1026-minBGlobin-FlpO-WPRE-BGHpA |
| 3027 | rAAV-mscRE1027-minBGlobin-FlpO-WPRE-BGHpA |
| 3028 | rAAV-mscRE1028-minBGlobin-FlpO-WPRE-BGHpA |
| 3029 | rAAV-mscRE1029-minBGlobin-FlpO-WPRE-BGHpA |
| 3030 | rAAV-mscRE1030-minBGlobin-FlpO-WPRE-BGHpA |
| 3031 | rAAV-mscRE1031-minBGlobin-FlpO-WPRE-BGHpA |
| 3032 | rAAV-mscRE1032-minBGlobin-FlpO-WPRE-BGHpA |
| 3033 | rAAV-mscRE1033-minBGlobin-FlpO-WPRE-BGHpA |
| 3034 | rAAV-mscRE1034-minBGlobin-FlpO-WPRE-BGHpA |
| 3035 | rAAV-mscRE1035-minBGlobin-FlpO-WPRE-BGHpA |
| 3036 | rAAV-mscRE1036-minBGlobin-FlpO-WPRE-BGHpA |
| 3037 | rAAV-mscRE1037-minBGlobin-FlpO-WPRE-BGHpA |
| 3038 | rAAV-mscRE1038-minBGlobin-FlpO-WPRE-BGHpA |
| 3039 | rAAV-mscRE1039-minBGlobin-FlpO-WPRE-BGHpA |
| 3040 | rAAV-mscRE1040-minBGlobin-FlpO-WPRE-BGHpA |
| 3041 | rAAV-mscRE1041-minBGlobin-FlpO-WPRE-BGHpA |
| 3042 | rAAV-mscRE1042-minBGlobin-FlpO-WPRE-BGHpA |
| 3043 | rAAV-mscRE1043-minBGlobin-FlpO-WPRE-BGHpA |
| 3044 | rAAV-mscRE1044-minBGlobin-FlpO-WPRE-BGHpA |
| 3045 | rAAV-mscRE1045-minBGlobin-FlpO-WPRE-BGHpA |
| 3046 | rAAV-mscRE1046-minBGlobin-FlpO-WPRE-BGHpA |
| 3047 | rAAV-mscRE1047-minBGlobin-FlpO-WPRE-BGHpA |
| 3048 | rAAV-mscRE1048-minBGlobin-FlpO-WPRE-BGHpA |
| 3049 | rAAV-mscRE1049-minBGlobin-FlpO-WPRE-BGHpA |
| 3050 | rAAV-mscRE1050-minBGlobin-FlpO-WPRE-BGHpA |
| 3051 | rAAV-mscRE1051-minBGlobin-FlpO-WPRE-BGHpA |
| 3052 | rAAV-mscRE1052-minBGlobin-FlpO-WPRE-BGHpA |

Subcomponent sequences within the larger vector sequences can be readily identified by one of ordinary skill in the art and based on the contents of the current disclosure (see FIGS. 2C-2E). Nucleotides between identifiable and enumerated subcomponents reflect restriction enzyme recognition sites used in assembly (cloning) of the constructs, and in some cases, additional nucleotides do not convey any identifiable function. These segments of complete vector sequences can be adjusted based on use of different cloning strategies and/or vectors. In general, short 6-nucleotide palindromic sequences reflect vector construction artifacts that are not important to vector function.

In particular embodiments vectors (e.g., AAV) with capsids that cross the blood-brain barrier (BBB) are selected. In particular embodiments, vectors are modified to include capsids that cross the BBB. Examples of AAV with viral capsids that cross the blood brain barrier include AAV9 (Gombash et al., Front Mol Neurosci. 2014; 7:81), AAVrh.10 (Yang, et al., Mol Ther. 2014; 22(7): 1299-1309), AAV1R6, AAV1R7 (Albright et al., Mol Ther. 2018; 26(2): 510), rAAVrh.8 (Yang, et al., supra), AAV-BR1 (Marchio et al., EMBO Mol Med. 2016; 8(6): 592), AAV-PHP.S (Chan et al., Nat Neurosci. 2017; 20(8): 1172), AAV-PHP.B (Deverman et al., Nat Biotechnol. 2016; 34(2): 204), AAV-PPS (Chen et al., Nat Med. 2009; 15: 1215), and PHP.eB. In particular embodiments, the PHP.eB capsid differs from AAV9 such that, using AAV9 as a reference, amino acids starting at residue 586: S-AQ-A (SEQ ID NO: 1) are changed to S-DGTLAVPFK-A (SEQ ID NO: 2). In particular embodiments, PHP.eb refers to the sequence designated as such in FIG. 27.

AAV9 is a naturally occurring AAV serotype that, unlike many other naturally occurring serotypes, can cross the BBB following intravenous injection. It transduces large sections of the central nervous system (CNS), thus permitting minimally invasive treatments (Naso et al., BioDrugs. 2017; 31(4): 317), for example, as described in relation to clinical trials for the treatment of spinal muscular atrophy (SMA) syndrome by AveXis (AVXS-101, NCT03505099) and the treatment of CLN3 gene-Related Neuronal Ceroid-Lipofuscinosis (NCT03770572).

AAVrh.10, was originally isolated from rhesus macaques and shows low seropositivity in humans when compared with other common serotypes used for gene delivery applications (Selot et al., Front Pharmacol. 2017; 8: 441) and has been evaluated in clinical trials LYS-SAF302, LYSOGENE, and NCT03612869.

AAV1R6 and AAV1R7, two variants isolated from a library of chimeric AAV vectors (AAV1 capsid domains swapped into AAVrh.10), retain the ability to cross the BBB and transduce the CNS while showing significantly reduced hepatic and vascular endothelial transduction.

rAAVrh.8, also isolated from rhesus macaques, shows a global transduction of glial and neuronal cell types in regions of clinical importance following peripheral administration and also displays reduced peripheral tissue tropism compared to other vectors.

AAV-BR1 is an AAV2 variant displaying the NRGTEWD (SEQ ID NO: 3) epitope that was isolated during in vivo screening of a random AAV display peptide library. It shows high specificity accompanied by high transgene expression in the brain with minimal off-target affinity (including for the liver) (Körbelin et al., EMBO Mol Med. 2016; 8(6): 609).

AAV-PHP.S (Addgene, Watertown, MA) is a variant of AAV9 generated with the CREATE method that encodes the 7-mer sequence QAVRTSL (SEQ ID NO: 4), transduces neurons in the enteric nervous system, and strongly trans-duces peripheral sensory afferents entering the spinal cord and brain stem.

AAV-PHP.B (Addgene, Watertown, MA) is a variant of AAV9 generated with the CREATE method that encodes the 7-mer sequence TLAVPFK (SEQ ID NO: 5). It transfers genes throughout the CNS with higher efficiency than AAV9 and transduces the majority of astrocytes and neurons across multiple CNS regions.

AAV-PPS, an AAV2 variant crated by insertion of the DSPAHPS (SEQ ID NO: 6) epitope into the capsid of AAV2, shows a dramatically improved brain tropism relative to AAV2.

For additional information regarding capsids that cross the blood brain barrier, see Chan et al., Nat. Neurosci. 2017 August: 20(8): 1172-1179.

(ii) Compositions for Administration. Artificial expression constructs and vectors of the present disclosure (referred to herein as physiologically active components) can be formulated with a carrier that is suitable for administration to a cell, tissue slice, animal (e.g., mouse, non-human primate), or human. Physiologically active components within compositions described herein can be prepared in neutral forms, as freebases, or as pharmacologically acceptable salts.

Pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like.

Carriers of physiologically active components can include solvents, dispersion media, vehicles, coatings, diluents, isotonic and absorption delaying agents, buffers, solutions, suspensions, colloids, and the like. The use of such carriers for physiologically active components is well known in the art. Except insofar as any conventional media or agent is incompatible with the physiologically active components, it can be used with compositions as described herein.

The phrase "pharmaceutically-acceptable carriers" refer to carriers that do not produce an allergic or similar untoward reaction when administered to a human, and in particular embodiments, when administered intravenously (e.g. at the retro-orbital plexus).

In particular embodiments, compositions can be formulated for intravenous, intraparenchymal, intraocular, intravitreal, parenteral, subcutaneous, intracerebro-ventricular, intramuscular, intrathecal, intraspinal, intraperitoneal, oral or nasal inhalation, or by direct injection in or application to one or more cells, tissues, or organs.

Compositions may include liposomes, lipids, lipid complexes, microspheres, microparticles, nanospheres, and/or nanoparticles.

The formation and use of liposomes is generally known to those of skill in the art. Liposomes have been developed with improved serum stability and circulation half-times (see, for instance, U.S. Pat. No. 5,741,516). Further, various methods of liposome and liposome like preparations as potential drug carriers have been described (see, for instance U.S. Pat. Nos. 5,567,434; 5,552,157; 5,565,213; 5,738,868; and 5,795,587).

The disclosure also provides for pharmaceutically acceptable nanocapsule formulations of the physiologically active components. Nanocapsules can generally entrap compounds in a stable and reproducible way (Quintanar-Guerrero et al., Drug Dev Ind Pharm 24(12):1113-1128, 1998; Quintanar-Guerrero et al., Pharm Res. 15(7):1056-1062, 1998; Quintanar-Guerrero et al., J. Microencapsul. 15(1):107-119, 1998; Douglas et al., Crit Rev Ther Drug Carrier Syst 3(3):233-261, 1987). To avoid side effects due to intracellular polymeric overloading, such ultrafine particles can be designed using polymers able to be degraded in vivo. Biodegradable polyalkyl-cyanoacrylate nanoparticles that meet these requirements are contemplated for use in the present disclosure. Such particles can be easily made, as described in Couvreur et al., J Pharm Sci 69(2):199-202, 1980; Couvreur et al., Crit Rev Ther Drug Carrier Syst. 5(1)1-20, 1988; zur Muhlen et al., Eur J Pharm Biopharm, 45(2):149-155, 1998; Zambaux et al., J Control Release 50(1-3):31-40, 1998; and U.S. Pat. No. 5,145,684.

Injectable compositions can include sterile aqueous solutions or dispersions and sterile powders for the extemporaneous preparation of sterile injectable solutions or dispersions (U.S. Pat. No. 5,466,468). For delivery via injection, the form is sterile and fluid to the extent that it can be delivered by syringe. In particular embodiments, it is stable under the conditions of manufacture and storage, and optionally contains one or more preservative compounds against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion, and/or by the use of surfactants. The prevention of the action of microorganisms can be brought about by various antibacterial and/or antifungal agents, for example, parabens, chlorobutanol, phenol, sorbic acid, thimerosal, and the like. In various embodiments, the preparation will include an isotonic agent(s), for example, sugar(s) or sodium chloride. Prolonged absorption of the injectable compositions can be accomplished by including in the compositions of agents that delay absorption, for example, aluminum monostearate and gelatin. Injectable compositions can be suitably buffered, if necessary, and the liquid diluent first rendered isotonic with sufficient saline or glucose.

Dispersions may also be prepared in glycerol, liquid polyethylene glycols, and mixtures thereof and in oils. As indicated, under ordinary conditions of storage and use, these preparations can contain a preservative to prevent the growth of microorganisms.

Sterile compositions can be prepared by incorporating the physiologically active component in an appropriate amount of a solvent with other optional ingredients (e.g., as enumerated above), followed by filtered sterilization. Generally, dispersions are prepared by incorporating the various sterilized physiologically active components into a sterile vehicle that contains the basic dispersion medium and the required other ingredients (e.g., from those enumerated above). In the case of sterile powders for the preparation of sterile injectable solutions, preferred methods of preparation can be vacuum-drying and freeze-drying techniques which yield a powder of the physiologically active components plus any additional desired ingredient from a previously sterile-filtered solution thereof.

Oral compositions may be in liquid form, for example, as solutions, syrups or suspensions, or may be presented as a drug product for reconstitution with water or other suitable vehicle before use. Such liquid preparations may be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). The compositions may take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). Tablets may be coated by methods well-known in the art.

Inhalable compositions can be delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of, e.g., gelatin for use in an inhaler or insufflator may be formulated containing a powder mix of the compound and a suitable powder base such as lactose or starch.

Compositions can also include microchip devices (U.S. Pat. No. 5,797,898), ophthalmic formulations (Bourlais et al., Prog Retin Eye Res, 17(1):33-58, 1998), transdermal matrices (U.S. Pat. Nos. 5,770,219 and 5,783,208), feedback-controlled delivery (U.S. Pat. No. 5,697,899), and any other delivery method available and/or described elsewhere in the disclosure.

Supplementary active ingredients can also be incorporated into the compositions.

Typically, compositions can include at least 0.1% of the physiologically active components or more, although the percentage of the physiologically active components may, of course, be varied and may conveniently be between 1 or 2% and 70% or 80% or more or 0.5-99% of the weight or volume of the total composition. Naturally, the amount of physiologically active components in each physiologically-useful composition may be prepared in such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of compositions and dosages may be desirable.

In particular embodiments, for administration to humans, compositions should meet sterility, pyrogenicity, and the general safety and purity standards as required by United States Food and Drug Administration (FDA) or other applicable regulatory agencies in other countries.

(iii) Cell Lines Including Artificial Expression Constructs. The present disclosure includes cells including an artificial expression construct described herein. A cell that has been transformed with an artificial expression construct can be used for many purposes, including in neuroanatomical studies, assessments of functioning and/or non-functioning proteins, and drug screens that assess the regulatory properties of enhancers.

A variety of host cell lines can be used, but in particular embodiments, the cell is a mammalian non-neuronal cell. In particular embodiments, the artificial express construct includes an enhancer and/or a vector sequence of eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_357h, eHGT_371h, eHGT_371m, eHGT_372h, eHGT_372m, eHGT_373m, 3xcore eHGT_373m, eHGT_374m, eHGT_375h, eHGT_375m, eHGT_376h, eHGT_376m, eHGT_377h, eHGT_379m, eHGT_380m, eHGT_381h, eHGT_381m, eHGT_382h, eHGT_382m, eHGT_383h, eHGT_383m, eHGT_384h, eHGT_384m, eHGT_385m, eHGT_386m, eHGT_387h, eHGT_387m, eHGT_388h, eHGT_388m, eHGT_389h, eHGT_390h, eHGT_390m, 3xcore eHGT_390m, eHGT_391m, eHGT_392h, eHGT_393h, eHGT_393m, eHGT_394h, eHGT_395h, eHGT_396h, eHGT_396m, eHGT_397h, eHGT_397m, eHGT_398h, eHGT_398m, eHGT_399h, eHGT_399m, eHGT_400h, eHGT_400m, eHGT_401m, eHGT_402h, eHGT_402m, eHGT_403m, eHGT_404h, eHGT_405h, eHGT_405m, eHGT_406h, eHGT_406m, eHGT_407h, eHGT_641m, eHGT_407m, eHGT_408h, eHGT_408m, eHGT_409m, eHGT_410m, 3xcore eHGT_410m, eHGT_411h, eHGT_411m, eHGT_412h, eHGT_412m, eHGT_413h, eHGT_414h, eHGT_414m, eHGT_415m, eHGT_416m, eHGT_417h, eHGT_417m, eHGT_418h, eHGT_418m, eHGT_419h, eHGT_419m, eHGT_420h, eHGT_420m, eHGT_421m, eHGT_422m, eHGT_423h, eHGT_423m, eHGT_424h, eHGT_424m, eHGT_425h, eHGT_425m, eHGT_426h, eHGT_426m, eHGT_427h, eHGT_427m, eHGT_428h, eHGT_428m, eHGT_429h, eHGT_429m, eHGT_430h, eHGT_430m, eHGT_495m, eHGT_497m, eHGT413m, mscRE1001, mscRE1002, mscRE1003, mscRE1004, mscRE1005, mscRE1006, mscRE1007, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, mscRE1022, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, or mscRE1052 and/or CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155, CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, or 3052, and the cell line is a human, primate, or murine non-neuronal cell. Cell lines which can be utilized for transgenesis in the present disclosure also include primary cell lines derived from living tissue such as rat or mouse brains and organo-typic cell cultures, including brain slices from animals such as rats or mice.

In particular embodiments, non-neuronal cell lines may be used, including mouse embryonic stem cells. Cultured mouse embryonic stem cells can be used to analyze expression of genetic constructs using transient transfection with plasmid constructs. Mouse embryonic stem cells are pluripotent and undifferentiated. These cells can be maintained in this undifferentiated state by Leukemia Inhibitory Factor (LIF). Withdrawal of LIF induces differentiation of the embryonic stem cells. In culture, the stem cells form a variety of differentiated cell types. Differentiation is caused by the expression of tissue specific transcription factors, allowing the function of an enhancer sequence to be evaluated. (See for example Fiskerstrand et al., FEBS Lett 458: 171-174, 1999.)

In particular embodiments, "neuronal" describes something that is of, related to, or includes, neuronal cells. Neuronal cells are defined by the presence of an axon and dendrites. The term "neuronal-specific" refers to something that is found, or an activity that occurs, in neuronal cells or cells derived from neuronal cells, but is not found in or occur in, or is not found substantially in or occur substantially in, non-neuronal cells or cells not derived from neuronal cells, for example glial cells such as astrocytes or oligodendro-cytes.

Methods to differentiate stem cells into different cell types include replacing a stem cell culture media with a media including basic fibroblast growth factor (bFGF) heparin, an N2 supplement (e.g., transferrin, insulin, progesterone, putrescine, and selenite), laminin and polyornithine. A process to produce myelinating oligodendrocytes from stem cells is described in Hu, et al., 2009, Nat. Protoc. 4:1614-22. U.S. Publication No. 2012/0308530 describes a culture surface with amino groups that promotes differentiation into neurons, astrocytes and oligodendrocytes. Thus, the fate of stem cells can be controlled by a variety of extracellular factors. Commonly used factors include brain derived growth factor (BDNF; Shetty and Turner, 1998, J. Neurobiol. 35:395-425); fibroblast growth factor (bFGF; U.S. Pat. No. 5,766,948; FGF-1, FGF-2); Neurotrophin-3 (NT-3) and Neurotrophin-4 (NT-4); Caldwell, et al., 2001, Nat. Biotechnol. 1; 19:475-9); ciliary neurotrophic factor (CNTF); BMP-2 (U.S. Pat. Nos. 5,948,428 and 6,001,654); isobutyl 3-methylxanthine; leukemia inhibitory growth factor (LIF; U.S. Pat. No. 6,103,530); somatostatin; amphiregulin; neu-rotrophins (e.g., cyclic adenosine monophosphate; epidermal growth factor (EGF); dexamethasone (glucocorticoid hormone); forskolin; GDNF family receptor ligands; potassium; retinoic acid (U.S. Pat. No. 6,395,546); tetanus toxin; and transforming growth factor-α and TGF-β (U.S. Pat. Nos. 5,851,832 and 5,753,506).

In particular embodiments, yeast one-hybrid systems may also be used to identify compounds that inhibit specific protein/DNA interactions, such as transcription factors for the eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_357h, eHGT_371h, eHGT_371m, eHGT_372h, eHGT_372m, eHGT_373m, 3xcore eHGT_373m, eHGT_374m, eHGT_375h, eHGT_375m, eHGT_376h, eHGT_376m, eHGT_377h, eHGT_379m, eHGT_380m, eHGT_381h, eHGT_381m, eHGT_382h, eHGT_382m, eHGT_383h, eHGT_383m, eHGT_384h, eHGT_384m, eHGT_385m, eHGT_386m, eHGT_387h, eHGT_387m, eHGT_388h, eHGT_388m, eHGT_389h, eHGT_390h, eHGT_390m, 3xcore eHGT_390m, eHGT_391m, eHGT_392h, eHGT_393h, eHGT_393m, eHGT_394h, eHGT_395h, eHGT_396h, eHGT_396m, eHGT_397h, eHGT_397m, eHGT_398h, eHGT_398m, eHGT_399h, eHGT_399m, eHGT_400h, eHGT_400m, eHGT_401m, eHGT_402h, eHGT_402m, eHGT_403m, eHGT_404h, eHGT_405h, eHGT_405m, eHGT_406h, eHGT_406m, eHGT_407h, eHGT_641m, eHGT_407m, eHGT_408h, eHGT_408m, eHGT_409m, eHGT_410m, 3xcore eHGT_410m, eHGT_411h, eHGT_411m, eHGT_412h, eHGT_412m, eHGT_413h, eHGT_414h, eHGT_414m, eHGT_415m, eHGT_416m, eHGT_417h, eHGT_417m, eHGT_418h, eHGT_418m, eHGT_419h, eHGT_419m, eHGT_420h, eHGT_420m, eHGT_421m, eHGT_422m, eHGT_423h, eHGT_423m, eHGT_424h, eHGT_424m, eHGT_425h, eHGT_425m, eHGT_426h, eHGT_426m, eHGT_427h, eHGT_427m, eHGT_428h, eHGT_428m, eHGT_429h, eHGT_429m, eHGT_430h, eHGT_430m, eHGT_495m, eHGT_497m, eHGT413m, mscRE1001, mscRE1002, mscRE1003, mscRE1004, mscRE1005, mscRE1006, mscRE1007, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, mscRE1022, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, or mscRE1052.

Transgenic animals are described below. Cell lines may also be derived from such transgenic animals. For example, primary tissue culture from transgenic mice (e.g., also as described below) can provide cell lines with the artificial expression construct already integrated into the genome. (for an example see MacKenzie & Quinn, Proc Natl Acad Sci USA 96: 15251-15255, 1999).

(iv) Transgenic Animals. Another aspect of the disclosure includes transgenic animals, the genome of which contains an artificial expression construct eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_357h, eHGT_371h, eHGT_371m, eHGT_372h, eHGT_372m, eHGT_373m, 3xcore eHGT_373m, eHGT_374m, eHGT_375h, eHGT_375m, eHGT_376h, eHGT_376m, eHGT_377h, eHGT_379m, eHGT_380m, eHGT_381h, eHGT_381m, eHGT_382h, eHGT_382m, eHGT_383h, eHGT_383m, eHGT_384h, eHGT_384m, eHGT_385m, eHGT_386m, eHGT_387h, eHGT_387m, eHGT_388h, eHGT_388m, eHGT_389h, eHGT_390h, eHGT_390m, 3xcore eHGT_390m, eHGT_391m, eHGT_392h, eHGT_393h, eHGT_393m, eHGT_394h, eHGT_395h, eHGT_396h, eHGT_396m, eHGT_397h, eHGT_397m, eHGT_398h, eHGT_398m, eHGT_399h, eHGT_399m, eHGT_400h, eHGT_400m, eHGT_401m, eHGT_402h, eHGT_402m, eHGT_403m, eHGT_404h, eHGT_405h, eHGT_405m, eHGT_406h, eHGT_406m, eHGT_407h, eHGT_641m, eHGT_407m, eHGT_408h, eHGT_408m, eHGT_409m, eHGT_410m, 3xcore eHGT_410m, eHGT_411h, eHGT_411m, eHGT_412h, eHGT_412m, eHGT_413h, eHGT_414h, eHGT_414m, eHGT_415m, eHGT_416m, eHGT_417h, eHGT_417m, eHGT_418h, eHGT_418m, eHGT_419h, eHGT_419m, eHGT_420h, eHGT_420m, eHGT_421m, eHGT_422m, eHGT_423h, eHGT_423m, eHGT_424h, eHGT_424m, eHGT_425h, eHGT_425m, eHGT_426h, eHGT_426m, eHGT_427h, eHGT_427m, eHGT_428h, eHGT_428m, eHGT_429h, eHGT_429m, eHGT_430h, eHGT_430m, eHGT_495m, eHGT_497m, eHGT413m, mscRE1001, mscRE1002, mscRE1003, mscRE1004, mscRE1005, mscRE1006, mscRE1007, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, mscRE1022, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, or mscRE1052 operatively linked to a heterologous coding sequence. In particular embodiments, the genome of a transgenic animal includes CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155, CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, or 3052. In particular embodiments, when a non-integrating vector is utilized, a transgenic animal includes an artificial expression construct including eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_357h, eHGT_371h, eHGT_371m, eHGT_372h, eHGT_372m, eHGT_373m, 3xcore eHGT_373m, eHGT_374m, eHGT_375h, eHGT_375m, eHGT_376h, eHGT_376m, eHGT_377h, eHGT_379m, eHGT_380m, eHGT_381h, eHGT_381m, eHGT_382h, eHGT_382m, eHGT_383h, eHGT_383m, eHGT_384h, eHGT_384m, eHGT_385m, eHGT_386m, eHGT_387h, eHGT_387m, eHGT_388h, eHGT_388m, eHGT_389h, eHGT_390h, eHGT_390m, 3xcore eHGT_390m, eHGT_391m, eHGT_392h, eHGT_393h, eHGT_393m, eHGT_394h, eHGT_395h, eHGT_396h, eHGT_396m, eHGT_397h, eHGT_397m, eHGT_398h, eHGT_398m, eHGT_399h, eHGT_399m, eHGT_400h, eHGT_400m, eHGT_401m, eHGT_402h, eHGT_402m, eHGT_403m, eHGT_404h, eHGT_405h, eHGT_405m, eHGT_406h, eHGT_406m, eHGT_407h, eHGT_641m, eHGT_407m, eHGT_408h, eHGT_408m, eHGT_409m, eHGT_410m, 3xcore eHGT_410m, eHGT_411h, eHGT_411m, eHGT_412h, eHGT_412m, eHGT_413h, eHGT_414h, eHGT_414m, eHGT_415m, eHGT_416m, eHGT_417h, eHGT_417m, eHGT_418h, eHGT_418m, eHGT_419h, eHGT_419m, eHGT_420h, eHGT_420m, eHGT_421m, eHGT_422m, eHGT_423h, eHGT_423m, eHGT_424h, eHGT_424m, eHGT_425h, eHGT_425m, eHGT_426h, eHGT_426m, eHGT_427h, eHGT_427m, eHGT_428h, eHGT_428m, eHGT_429h, eHGT_429m, eHGT_430h, eHGT_430m, eHGT_495m, eHGT_497m, eHGT413m, mscRE1001, mscRE1002, mscRE1003, mscRE1004, mscRE1005, mscRE1006, mscRE1007, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, mscRE1022, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, or mscRE1052 and/or CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155, CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, or 3052 within one or more of its cells.

Detailed methods for producing transgenic animals are described in U.S. Pat. No. 4,736,866. Transgenic animals may be of any nonhuman species, but preferably include nonhuman primates (NHPs), sheep, horses, cattle, pigs, goats, dogs, cats, rabbits, chickens, and rodents such as guinea pigs, hamsters, gerbils, rats, mice, and ferrets.

In particular embodiments, construction of a transgenic animal results in an organism that has an engineered construct present in all cells in the same genomic integration site. Thus, cell lines derived from such transgenic animals will be consistent in as much as the engineered construct will be in the same genomic integration site in all cells and hence will suffer the same position effect variegation. In contrast, introducing genes into cell lines or primary cell cultures can give rise to heterologous expression of the construct. A disadvantage of this approach is that the expression of the introduced DNA may be affected by the specific genetic background of the host animal.

As indicated above in relation to cell lines, the artificial expression constructs of this disclosure can be used to genetically modify mouse embryonic stem cells using techniques known in the art. Typically, the artificial expression construct is introduced into cultured murine embryonic stem cells. Transformed ES cells are then injected into a blastocyst from a host mother and the host embryo re-implanted into the mother. This results in a chimeric mouse whose tissues are composed of cells derived from both the embryonic stem cells present in the cultured cell line and the embryonic stem cells present in the host embryo. Usually the mice from which the cultured ES cells used for transgenesis are derived are chosen to have a different coat color from the host mouse into whose embryos the transformed cells are to be injected. Chimeric mice will then have a variegated coat color. As long as the germ-line tissue is derived, at least in part, from the genetically modified cells, then the chimeric mice crossed with an appropriate strain can produce offspring that will carry the transgene.

In addition to the methods of delivery described above, the following techniques are also contemplated as alternative methods of delivering artificial expression constructs to target cells or selected tissues and organs of an animal, and in particular, to cells, organs, or tissues of a vertebrate mammal: sonophoresis (e.g., ultrasound, as described in U.S. Pat. No. 5,656,016); intraosseous injection (U.S. Pat. No. 5,779,708); microchip devices (U.S. Pat. No. 5,797,898); ophthalmic formulations (Bourlais et al., Prog Retin Eye Res, 17(1):33-58, 1998); transdermal matrices (U.S. Pat. Nos. 5,770,219 and 5,783,208); and feedback-controlled delivery (U.S. Pat. No. 5,697,899), and any other delivery method available and/or described elsewhere in the disclosure.

(v) Methods of Use. In particular embodiments, a composition including a physiologically active component described herein is administered to a subject to result in a physiological effect.

In particular embodiments, the disclosure includes the use of the artificial expression constructs described herein to modulate expression of a heterologous gene which is either partially or wholly encoded in a location downstream to that enhancer in an engineered sequence. Thus, there are provided herein methods of use of the disclosed artificial expression constructs in the research, study, and potential development of medicaments for preventing, treating or ameliorating the symptoms of a disease, dysfunction, or disorder.

Particular embodiments include methods of administering to a subject an artificial expression construct that includes eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, mscRE1007, eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, eHGT_408h, eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, eHGT_430h, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, mscRE1052, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, or mscRE1022 and/or CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155, CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, or 3052 as described herein to drive selective expression of a gene in a selected cell type. The subject can be an isolated cell, a network of cells, a tissue slice, an experimental animal, a veterinary animal, or a human.

As is well known in the medical arts, dosages for any one subject depends upon many factors, including the subject's size, surface area, age, the particular compound to be administered, sex, time and route of administration, general health, and other drugs being administered concurrently.

Dosages for the compounds of the disclosure will vary, but, in particular embodiments, a dose could be from $10^5$ to $10^{100}$ copies of an artificial expression construct of the disclosure. In particular embodiments, a patient receiving intravenous, intraparenchymal, intraspinal, retro-orbital, or intrathecal administration can be infused with from $10^6$ to $10^{22}$ copies of the artificial expression construct.

An "effective amount" is the amount of a composition necessary to result in a desired physiological change in the subject. Effective amounts are often administered for research purposes. Effective amounts disclosed herein can cause a statistically-significant effect in an animal model or in vitro assay.

The amount of expression constructs and time of administration of such compositions will be within the purview of the skilled artisan having benefit of the present teachings. It is likely, however, that the administration of effective amounts of the disclosed compositions may be achieved by a single administration, such as for example, a single injection of sufficient numbers of infectious particles to provide an effect in the subject. Alternatively, in some circumstances, it may be desirable to provide multiple, or successive administrations of the artificial expression construct compositions or other genetic constructs, either over a relatively short, or a relatively prolonged period of time, as may be determined by the individual overseeing the administration of such compositions. For example, the number of infectious particles administered to a mammal may be $10^7$, $10^8$, $10^9$, $10^{10}$, $10^{11}$, $10^{12}$, $10^{13}$, or even higher, infectious particles/ml given either as a single dose or divided into two or more administrations as may be required to achieve an intended effect. In fact, in certain embodiments, it may be desirable to administer two or more different expression constructs in combination to achieve a desired effect.

In certain circumstances it will be desirable to deliver the artificial expression construct in suitably formulated compositions disclosed herein either by pipette, retro-orbital injection, subcutaneously, intraocularly, intravitreally, parenterally, subcutaneously, intravenously, intraparenchymally, intracerebro-ventricularly, intramuscularly, intrathecally, intraspinally, intraperitoneally, by oral or nasal inhalation, or by direct application or injection to one or more cells, tissues, or organs. The methods of administration may also include those modalities as described in U.S. Pat. Nos. 5,543,158; 5,641,515 and 5,399,363.

(vi) Kits and Commercial Packages. Kits and commercial packages contain an artificial expression construct described herein. The artificial expression construct can be isolated. In particular embodiments, the components of an expression product can be isolated from each other. In particular embodiments, the expression product can be within a vector, within a viral vector, within a cell, within a tissue slice or sample, and/or within a transgenic animal. Such kits may further include one or more reagents, restriction enzymes, peptides, therapeutics, pharmaceutical compounds, or means for delivery of the compositions such as syringes, injectables, and the like.

Embodiments of a kit or commercial package will also contain instructions regarding use of the included components, for example, in basic research, electrophysiological research, neuroanatomical research, and/or the research and/or treatment of a disorder, disease or condition.

The Exemplary Embodiments and Experimental Examples below are included to demonstrate particular embodiments of the disclosure. Those of ordinary skill in the art should recognize in light of the present disclosure that many changes can be made to the specific embodiments disclosed herein and still obtain a like or similar result without departing from the spirit and scope of the disclosure.

(vii) Exemplary Embodiments.

1. An artificial expression construct including (i) an enhancer selected from eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, mscRE1007, eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, eHGT_408h, eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, eHGT_430h, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, mscRE1052, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, and mscRE1022; (ii) a promoter; and (iii) a heterologous encoding sequence.

2. The artificial expression construct of embodiment 1, wherein the heterologous encoding sequence encodes an effector element or an expressible element.

3. The artificial expression construct of embodiment 2, wherein the effector element includes a reporter protein or a functional molecule.

4. The artificial expression construct of embodiment 3, wherein the reporter protein includes a fluorescent protein.

5. The artificial expression construct of embodiment 3 or 4, wherein the functional molecule includes a functional ion transporter, enzyme, transcription factor, receptor, membrane protein, cellular trafficking protein, signaling molecule, neurotransmitter, calcium reporter, channelrhodopsin, CRISPR/CAS molecule, editase, guide RNA molecule, microRNA, homologous recombination donor cassette, or a designer receptor exclusively activated by designer drug (DREADD).

6. The artificial expression construct of embodiment 2, wherein the expressible element includes a non-functional molecule.

7. The artificial expression construct of embodiment 6, wherein the non-functional molecule includes a non-functional ion transporter, enzyme, transcription factor, receptor, membrane protein, cellular trafficking protein, signaling molecule, neurotransmitter, calcium reporter, channelrhodopsin, CRISPR/CAS molecule, editase, guide RNA molecule, microRNA, homologous recombination donor cassette, or a DREADD.

8. The artificial expression construct of any of embodiments 1-7, wherein the artificial expression construct is associated with a capsid that crosses the blood brain barrier.

9. The artificial expression construct of embodiment 8, wherein the capsid includes PHP.eB, AAV-BR1, AAV-PHP.S, AAV-PHP.B, or AAV-PPS.

10. The artificial expression construct of any of embodiments 1-9, wherein the artificial expression construct includes or encodes a skipping element.

11. The artificial expression construct of embodiment 10, wherein the skipping element includes a 2A peptide and/or an internal ribosome entry site (IRES).

12. The artificial expression construct of embodiment 11, wherein the 2A peptide is selected from T2A, P2A, E2A, or F2A.

13. The artificial expression construct of any of embodiments 1-12, wherein the artificial expression construct includes a minimal promoter, a post-regulatory element, and/or an insulator (e.g., SP10 or 3XSP10).

14. The artificial expression construct of any of embodiments 1-13, wherein the artificial expression construct includes or encodes a set of features selected from: eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, mscRE1007, eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, eHGT_408h, eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, eHGT_430h, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, mscRE1052, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, mscRE1022, AAV, scAAV, rAAv, minBglobin, CMV, minCMV, minRho, minRho*, fluorescent protein (e.g., EGFP, SYFP, GFP), Cre, iCre, dgCre, FlpO, tTA2, SP10, 3XSP10, WPRE, and/or BGHpA.

15. The artificial expression construct of any of embodiments 1-14, wherein the artificial expression construct includes or encodes a set of features selected from: eHGT_373m-minBglobin-SYFP2-WPRE3-BGHpA; 3xCore_eHGT_373m-minBglobin-SYFP2-WPRE3-BGHpA; eHGT_375m-minBglobin-SYFP2-WPRE3-BGHpA; eHGT_379m-minBglobin-SYFP2-WPRE3-BGHpA; eHGT_372m-minBglobin-SYFP2-WPRE3-BGHpA; eHGT_384m-minBglobin-SYFP2-WPRE3-BGHpA; eHGT_386m-minBglobin-SYFP2-WPRE3-BGHpA; eHGT_390m-minBglobin-SYFP2-WPRE3-BGHpA; 3xCore2_eHGT_390m-minBglobin-SYFP2-WPRE3-BGHpA; eHGT_371m-minBglobin-SYFP2-WPRE3-BGHpA; eHGT_391m-minBglobin-SYFP2-WPRE3-BGHpA; eHGT_398m-minBglobin-SYFP2-WPRE3-BGHpA; eHGT_402m-minBglobin-SYFP2-WPRE3-BGHpA; eHGT_409m-minBglobin-SYFP2-WPRE3-BGHpA; eHGT_413m-minBglobin-SYFP2-WPRE3-BGHpA; eHGT_414m-minBglobin-SYFP2-WPRE3-BGHpA; eHGT_415m-minBglobin-SYFP2-WPRE3-BGHpA; eHGT_383m-minBglobin-SYFP2-WPRE3-BGHpA; eHGT_374m-minBglobin-SYFP2-WPRE3-BGHpA; eHGT_396m-minBglobin-SYFP2-WPRE3-BGHpA; eHGT_381m-minBglobin-SYFP2-WPRE3-BGHpA; eHGT_382m-minBglobin-SYFP2-WPRE3-BGHpA; eHGT_387m-minBglobin-SYFP2-WPRE3-BGHpA; eHGT_388m-minBglobin-SYFP2-WPRE3-BGHpA; eHGT_393m-minBglobin-SYFP2-WPRE3-BGHpA; eHGT_399m-minBglobin-SYFP2-WPRE3-BGHpA; eHGT_400m-minBglobin-SYFP2-WPRE3-BGHpA; eHGT_405m-minBglobin-SYFP2-WPRE3-BGHpA; eHGT_406m-minBglobin-SYFP2-WPRE3-BGHpA; eHGT_410m-minBglobin-SYFP2-WPRE3-BGHpA; 3xCore_eHGT_410m-minBglobin-SYFP2-WPRE3-BGHpA; eHGT_416m-minBglobin-SYFP2-WPRE3-BGHpA; eHGT_417m-minBglobin-SYFP2-WPRE3-BGHpA; eHGT_418m-minBglobin-SYFP2-WPRE3-BGHpA; eHGT_419m-minBglobin-SYFP2-WPRE3-BGHpA; eHGT_420m-minBglobin-SYFP2-WPRE3-BGHpA; eHGT_421m-minBglobin-SYFP2-WPRE3-BGHpA; eHGT_423m-minBglobin-SYFP2-WPRE3-BGHpA; eHGT_428m-minBglobin-SYFP2-WPRE3-BGHpA; eHGT_429m-minBglobin-SYFP2-WPRE3-BGHpA; eHGT_430m-minBglobin-SYFP2-WPRE3-BGHpA; eHGT_376m-minBglobin-SYFP2-WPRE3-BGHpA; eHGT_380m-minBglobin-SYFP2-WPRE3-BGHpA; eHGT_385m-minBglobin-SYFP2-WPRE3-BGHpA; eHGT_397m-minBglobin-SYFP2-WPRE3-BGHpA; eHGT_401m-minBglobin-SYFP2-WPRE3-BGHpA; eHGT_403m-minBglobin-SYFP2-WPRE3-BGHpA; eHGT_407m-minBglobin-SYFP2-WPRE3-BGHpA; eHGT_408m-minBglobin-SYFP2-WPRE3-BGHpA; eHGT_411m-minBglobin-SYFP2-WPRE3-BGHpA; eHGT_412m-minBglobin-SYFP2-WPRE3-BGHpA; eHGT_422m-minBglobin- SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
SYFP2-WPRE3-BGHpA;
minRho*-SYFP2-WPRE3-BGHpA;
minBglobin-SYFP2-WPRE3-BGHpA;
minBglobin-SYFP2-WPRE3-BGHpA;
minBGlobin-FlpO-WPRE-BGHpA;
minBGlobin-FlpO-WPRE-BGHpA;

eHGT_424m-minBglobin-
eHGT_425m-minBglobin-
eHGT_426m-minBglobin-
eHGT_427m-minBglobin-
eHGT_371h-minBglobin-
eHGT_372h-minBglobin-
eHGT_375h-minBglobin-
eHGT_376h-minBglobin-
eHGT_377h-minBglobin-
eHGT_381h-minBglobin-
eHGT_382h-minBglobin-
eHGT_383h-minBglobin-
eHGT_384h-minBglobin-
eHGT_387h-minBglobin-
eHGT_388h-minBglobin-
eHGT_389h-minBglobin-
eHGT_390h-minBglobin-
eHGT_392h-minBglobin-
eHGT_393h-minBglobin-
eHGT_394h-minBglobin-
eHGT_395h-minBglobin-
eHGT_396h-minBglobin-
eHGT_397h-minBglobin-
eHGT_398h-minBglobin-
eHGT_399h-minBglobin-
eHGT_400h-minBglobin-
eHGT_402h-minBglobin-
eHGT_404h-minBglobin-
eHGT_405h-minBglobin-
eHGT_406h-minBglobin-
eHGT_407h-minBglobin-
eHGT_641m-minBglobin-
eHGT_408h-minBglobin-
eHGT_411h-minBglobin-
eHGT_412h-minBglobin-
eHGT_413h-minBglobin-
eHGT_414h-minBglobin-
eHGT_417h-minBglobin-
eHGT_418h-minBglobin-
eHGT_419h-minBglobin-
eHGT_420h-minBglobin-
eHGT_423h-minBglobin-
eHGT_424h-minBglobin-
eHGT_425h-minBglobin-
eHGT_426h-minBglobin-
eHGT_427h-minBglobin-
eHGT_428h-minBglobin-
eHGT_429h-minBglobin-
eHGT_430h-minBglobin-
hsA2-eHGT_267h-minRho-
hsA2-eHGT_268h-minRho-
hsA2-eHGT_269h-minRho-
hsA2-eHGT_270h-minRho-
hsA2-eHGT_271h-minRho-
hsA2-eHGT_272h-minRho-
hsA2-eHGT_273h-minRho-
hsA2-eHGT_274h-minRho-
hsA2-eHGT_275h-minRho-
hsA2-eHGT_276h-minRho-
eHGT_315h-minBglobin-
eHGT_316h-minBglobin-
3xSP10ins-eHGT_357h-
eHGT_495m-
eHGT_497m-
mscRE1001-
mscRE1002-
mscRE1003- minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA;
minBGlobin-FlpO-WPRE-BGHpA, or
minBGlobin-FlpO-WPRE-BGHpA.

mscRE1004-
mscRE1005-
mscRE1006-
mscRE1007-
mscRE1008-
mscRE1009-
mscRE1010-
mscRE1011-
mscRE1012-
mscRE1013-
mscRE1014-
mscRE1015-
mscRE1016-
mscRE1017-
mscRE1018-
mscRE1019-
mscRE1020-
mscRE1021-
mscRE1022-
mscRE1023-
mscRE1024-
mscRE1025-
mscRE1026-
mscRE1027-
mscRE1028-
mscRE1029-
mscRE1030-
mscRE1031-
mscRE1032-
mscRE1033-
mscRE1034-
mscRE1035-
mscRE1036-
mscRE1037-
mscRE1038-
mscRE1039-
mscRE1040-
mscRE1041-
mscRE1042-
mscRE1043-
mscRE1044-
mscRE1045-
mscRE1046-
mscRE1047-
mscRE1048-
mscRE1049-
mscRE1050-
mscRE1051-
mscRE1052-

16. An enhancer promoter combination of embodiment 15 driving expression of a heterologous encoding sequence.

17. The vector of embodiment 15, wherein the vector is a viral vector.

18. The vector of embodiment 17, wherein the viral vector is a recombinant adeno-associated viral (AAV) vector.

19. An adeno-associated viral (AAV) vector including at least one heterologous encoding sequence, wherein the heterologous encoding sequence is under control of a promoter and an enhancer selected from eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, mscRE1007, eHGT_267h, eHGT_268h, eHGT_269h, eHGT_270h, eHGT_271h, eHGT_272h, eHGT_273h, eHGT_274h, eHGT_275h, eHGT_276h, eHGT_315h, eHGT_316h, eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, eHGT_408h, eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, eHGT_430h, mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, mscRE1037, mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, mscRE1052, mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, and mscRE1022.

20. A transgenic cell including an artificial expression construct or vector of any of the preceding embodiments.

21. The transgenic cell of embodiment 20, wherein the transgenic cell is an astrocyte, an oligodendrocyte, a microglial cell, a pericyte, an SMC, or an endothelial cell.

22. The transgenic cell of embodiment 20, wherein the transgenic cell is an L1 interlaminar astrocyte.

23. A non-human transgenic animal including an artificial expression construct, vector, or transgenic cell of any of the preceding embodiments.

24. The non-human transgenic animal of embodiment 23, wherein the non-human transgenic animal is a mouse or a non-human primate.

25. An administrable composition including an artificial expression construct, vector, or transgenic cell of any of the preceding embodiments.

26. A kit including an artificial expression construct, vector, transgenic cell, transgenic animal, and/or administrable compositions of any of the preceding embodiments.

27. A method for selectively expressing a heterologous gene within a population of non-neuronal cells in vivo or in vitro, the method including providing the administrable composition of embodiment 25 in a sufficient dosage and for a sufficient time to a sample or subject including the population of non-neuronal cells thereby selectively expressing the gene within the population of non-neuronal cells.

28. The method of embodiment 27, wherein the heterologous gene encodes an effector element or an expressible element.

29. The method of embodiment 28, wherein the effector element includes a reporter protein or a functional molecule.

30. The method of embodiment 29, wherein the reporter protein includes a fluorescent protein.

31. The method of embodiment 29 or 30, wherein the functional molecule includes a functional ion transporter, enzyme, transcription factor, receptor, membrane protein, cellular trafficking protein, signaling molecule, neurotransmitter, calcium reporter, channelrhodopsin, CRISPR/CAS molecule, editase, guide RNA molecule, microRNA, homologous recombination donor cassette, or a DREADD.

32. The method of embodiment 28, wherein the expressible element includes a non-functional molecule.

33. The method of embodiment 32, wherein the non-functional molecule includes a non-functional ion transporter, enzyme, transcription factor, receptor, membrane protein, cellular trafficking protein, signaling molecule, neurotransmitter, calcium reporter, channelrhodopsin, CRISPR/CAS molecule, editase, guide RNA molecule, microRNA, homologous recombination donor cassette, or DREADD.

34. The method of any of embodiments 27-33, wherein the providing includes pipetting.

35. The method of embodiment 34, wherein the pipetting is to a brain slice.

36. The method of embodiment 35, wherein the brain slice includes an astrocyte, an oligodendrocyte, a microglial cell, a pericyte, an SMC, and/or an endothelial cell.

37. The method of embodiment 35, wherein the brain slice includes an L1 interlaminar astrocyte.

38. The method of any of embodiments 35-37, wherein the brain slice is murine, human, or non-human primate.

39. The method of any of embodiments 27-33, wherein the providing includes administering to a living subject.

40. The method of embodiment 39, wherein the living subject is a human, non-human primate, or a mouse.

41. The method of any of embodiments 39 or 40, wherein the administering to a living subject is through injection.

42. The method of embodiment 41, wherein the injection includes intravenous injection, intraparenchymal injection into brain tissue, intracerebroventricular (ICV) injection, intra-cisterna *magna* (ICM) injection, or intrathecal injection.

43. An artificial expression construct including CN1781, CN1782, CN1783, CN1784, CN1785, CN1786, CN1787, CN1788, CN1789, CN1790, CN2044, CN2082, CN2083, CN2084, CN2560, CN2085, CN2086, CN2087, CN2088, CN2089, CN2558, CN2090, CN2091, CN2092, CN2093, CN2094, CN2095, CN2096, CN2097, CN2098, CN2099, CN2100, CN2101, CN2102, CN2103, CN2104, CN2105, CN2106, CN2107, CN2108, CN2109, CN2556, CN2110, CN2111, CN2112, CN2113, CN2114, CN2115, CN2116, CN2117, CN2118, CN2119, CN2120, CN2121, CN2122, CN2123, CN2124, CN2125, CN2126, CN2127, CN2128, CN2129, CN2130, CN2131, CN2132, CN2133, CN2134, CN2141, CN2142, CN2143, CN2144, CN2145, CN2146, CN2147, CN2148, CN2149, CN2150, CN2151, CN2152, CN2153, CN2154, CN2155, CN2156, CN2157, CN2158, CN2159, CN2160, CN2161, CN2162, CN2163, CN2164, CN2165, CN2166, CN2167, CN2845, CN2168, CN2169, CN2170, CN2171, CN2172, CN2173, CN2174, CN2175, CN2176, CN2177, CN2178, CN2179, CN2180, CN2181, CN2182, CN2183, CN2184, CN2243, CN2268, CN2345, CN2346, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, or 3052.

44. Any of the preceding embodiments including a concatenated core of the referenced enhancer or a core thereof, wherein the concatemer includes 2, 3, 4, 5, 6, 7, 8, 9, or 10 copies of the referenced enhancer or core thereof (as representative examples, 3xcore eHGT_410m, 3xcore eHGT_390m, and 3xcore eHGT_373m are particularly disclosed herein, and whose teachings can be applied to the remainder of the disclosed enhancer sequences).

(viii) Experimental Methods. Cloning enhancers. Enhancers were chosen for cloning from open chromatin data base on the following criteria: 1) a subclass-specific ATAC-seq peak identified by Homer (with –region flag) in both human and mouse (conserved) or only human (divergent), 2) a subclass-specific DMR in both human and mouse (conserved) or only human (divergent), 3) ranking by human ATAC-seq read counts within region, and 4) manual confirmation by visualization of read pileup. For rAAV (ssAAV) vectors a plasmid backbone from Addgene was used (plasmid number 51084 (AAV-hSyn1-GCaMP6s-P2A-nls-dTomato). This construct was itself originally derived from pAAV-GFP [Cell Biolabs catalog #VPK-410]). Enhancers were inserted by standard Gibson assembly approaches, upstream of a minimal beta-globin promoter and the reporter SYFP2, a brighter EGFP alternative that is well tolerated in neurons. NEB Stable cells (New England Biolabs #C30401) or Stb13 cells (Thermo Fisher #C7373-03) were used for transformations and cultured at 32° C. Left ITR recombination was not observed for rAAV plasmids.

Virus production. Enhancer AAV plasmids were maxiprepped and transfected with PEI Max 40K (Polysciences Inc., catalog #24765-1) into one 15 cm plate of AAV-293 cells (Cell Biolabs catalog #AAV-100), along with helper plasmid pHelper (Cell BioLabs) and PHP.eB rep/cap packaging plasmid (Chan et al., Nat Neurosci. 2017 August; 20(8):1172-1179. doi: 10.1038/nn.4593. Epub 2017 Jun. 26. PMID: 28671695; PMCID: PMC5529245), with a total mass of 150 µg PEI Max 40K, 30 µg pHelper, 15 µg rep/cap plasmid, and 15 µg enhancer-AAV vector. The next day medium was changed to 1% FBS, and then after 5 days cells and supernatant were harvested and AAV particles released by three freeze-thaw cycles. Lysate was then treated with benzonase to degrade free DNA (2 µL benzonase, 30 min at 37° C., MilliporeSigma catalog #E8263-25KU), and then cell debris was cleared with low-speed spin (1500 g 10 min). The supernatant containing virus was concentrated over a 100 kDa molecular weight cutoff Centricon column (MilliporeSigma catalog #Z648043) to a final volume of 150 µL. For highly purified large-scale preps this protocol was altered so that ten plates were transfected and harvested together at 3 days after transfection, and then the crude virus was purified by iodixanol gradient centrifugation.

Mouse virus testing. Mice were retro-orbitally injected at P42-P70 with 10 µL (2-3×10^{11} genome copies) of crude virus prep diluted with 100 µL PBS, then sacrificed at 21-28 days post infection. Mouse brain hemispheres were fixed by immersion in 4% PFA in PBS for 4-6 hours at 4° C. and sectioned into 350 µm sagittal slices on the Leica VT1000S vibratome. Fluorescence was detected in whole sagittal section with a 10× montage on the Olympus FV3000 confocal microscope ImageJ was used to perform analysis of the stitched images. single-cell RNA-seq from the mouse visual cortex was performed as described previously in (Tasic et al., Curr. Opin. Neurobiol. 50, 242-249 (2018)).

Multiplexed FISH by hybridization chain reaction (mFISH) was performed on primate brain slices fixed by immersion in 4% PFA in PBS for 4-6 hours at 4° C. After fixation, hemispheres were rinsed with PBS and stored in PBS at 4° C. for up to one month. For sectioning, hemispheres were embedded in 1% low-melt agarose in PBS and cut 50 µm sagittal sections on a Leica VT1000S vibratome in cold PBS buffer. Sections were post-fixed in 4% PFA in PBS for 2 hours and then rinsed in PBS at room temperature, then dehydrated with 70% ethanol at 4° C. Afterwards sections could be stored for up to a month in 4° C. For staining, sections were cleared with 8% SDS in PBS for 2 hours at room temperature then washed three times in 2×SSC for 1 hour each, then with Hybridization Buffer (Molecular Instruments) in a new well before applying Hybridization Buffer containing HCR Probes and hybridized overnight at 37° C. The next day samples were washed with 30% Probe Wash Buffer for 1 hour at 37° C., then rinsed with 2×SSC. During the probe wash, fluorescently labeled HCR hairpins were denatured at 95° C. for 90 seconds and then snap-cooled in a room temperature aluminum block tube holder for 30 minutes. The denatured hairpins were added to Amplification Buffer and applied to tissue sections for 2 hours at room temperature in the dark, then washed with 2×SSC containing DAPI, again with 2×SSC, and finally mounted on SuperFrost Plus slides in Prolong Glass Mounting medium (Thermo Fisher Scientific #P36980). These HCR stains were imaged with an Olympus FV3000 confocal microscope using manufacturer's software. Molecular Instruments generated HCR probes against the following transcripts: SLC17A7, GAD1, FGFR3, and SOX10.

In vivo non-human primate AAV vector testing. All procedures used with macaque monkeys conformed to the guidelines provided by the US National Institutes of Health and were approved by the University of Washington Animal Care and Use Committee. Animals were injected with a single AAV vector in up to ten injection sites during a single surgery. AAVs were purified by iodixanol gradient ultracentrifugation for this procedure. After craniotomy, using a pneumatic pico pump (World Precision Instruments) a total of 5 µL AAV vector was injected at each site with 500 nL expelled at each of ten depths evenly spaced from 2 mm to 200 µm deep beneath the pial surface. Sites were separated by 1 cm in each region with multiple injection sites. 51 to 113 days after injection, the animals were sacrificed. We inspected the brain surface, cut tissue blocks (2×2×2 cm) around each visible fluorescent spot, and fixed each block 4% PFA in PBS for 24 hours at 4° C. After PFA fixation, blocks were embedded in 2% agarose in PBS and cut 350 µm sections and each inspected for fluorescent cells. Proper recovery of sites was confirmed by PCR on DNA from dissected fixed thick slices (recovered with QIAamp DNA FFPE Tissue Kit, Qiagen catalog #56404) using common primers to all vectors: F 5'-ACTCCAT-CACTAGGGGTTCCTG (SEQ ID NO: 366) and R 5'-GGACACGCTGAACTTGTGGC (SEQ ID NO: 367) followed by Sanger sequencing with the nested reverse primer 5'-ACGTCGCCGTCCAGCTC (SEQ ID NO: 368). Slices were co-stained with DAPI and/or propidium iodide and imaged on a Nikon Tie inverted fluorescence microscope. 350 µm sections were used to evaluate on-target expression using mFISH.

(ix) Closing Paragraphs. Variants of the sequences disclosed and referenced herein are also included. Guidance in determining which amino acid residues can be substituted, inserted, or deleted without abolishing biological activity can be found using computer programs well known in the art, such as DNASTAR™ (Madison, WI) software. Preferably, amino acid changes in the protein variants disclosed herein are conservative amino acid changes, i.e., substitutions of similarly charged or uncharged amino acids. A conservative amino acid change involves substitution of one of a family of amino acids which are related in their side chains.

In a peptide or protein, suitable conservative substitutions of amino acids are known to those of skill in this art and generally can be made without altering a biological activity of a resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. Co., p. 224). Naturally occurring amino acids are generally divided into conservative substitution families as follows: Group 1: Alanine (Ala), Glycine (Gly), Serine (Ser), and Threonine (Thr); Group 2: (acidic): Aspartic acid (Asp), and Glutamic acid (Glu); Group 3: (acidic; also classified as polar, negatively charged residues and their amides): Asparagine (Asn), Glutamine (Gln), Asp, and Glu; Group 4: Gln and Asn; Group 5: (basic; also classified as polar, positively charged residues): Arginine (Arg), Lysine (Lys), and Histidine (His); Group 6 (large aliphatic, nonpolar residues): Isoleucine (Ile), Leucine (Leu), Methionine (Met), Valine (Val) and Cysteine (Cys); Group 7 (uncharged polar): Tyrosine (Tyr), Gly, Asn, Gln, Cys, Ser, and Thr; Group 8 (large aromatic residues): Phenylalanine (Phe), Tryptophan (Trp), and Tyr; Group 9 (non-polar): Proline (Pro), Ala, Val, Leu, Ile, Phe, Met, and Trp; Group 11 (aliphatic): Gly, Ala, Val, Leu, and Ile; Group 10 (small aliphatic, nonpolar or slightly polar residues): Ala, Ser, Thr, Pro, and Gly; and Group 12 (sulfur-containing): Met and Cys. Additional information can be found in Creighton (1984) Proteins, W.H. Freeman and Company.

In making such changes, the hydropathic index of amino acids may be considered. The importance of the hydropathic amino acid index in conferring interactive biologic function on a protein is generally understood in the art (Kyte and Doolittle, 1982, J. Mol. Biol. 157(1), 105-32). Each amino acid has been assigned a hydropathic index on the basis of its hydrophobicity and charge characteristics (Kyte and Doolittle, 1982). These values are: Ile (+4.5); Val (+4.2); Leu (+3.8); Phe (+2.8); Cys (+2.5); Met (+1.9); Ala (+1.8); Gly (−0.4); Thr (−0.7); Ser (−0.8); Trp (−0.9); Tyr (−1.3); Pro (−1.6); His (−3.2); Glutamate (−3.5); Gln (−3.5); aspartate (−3.5); Asn (−3.5); Lys (−3.9); and Arg (−4.5).

It is known in the art that certain amino acids may be substituted by other amino acids having a similar hydropathic index or score and still result in a protein with similar biological activity, i.e., still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity.

As detailed in U.S. Pat. No. 4,554,101, the following hydrophilicity values have been assigned to amino acid residues: Arg (+3.0); Lys (+3.0); aspartate (+3.0±1); glutamate (+3.0±1); Ser (+0.3); Asn (+0.2); Gln (+0.2); Gly (0); Thr (−0.4); Pro (−0.5±1); Ala (−0.5); His (−0.5); Cys (−1.0); Met (−1.3); Val (−1.5); Leu (−1.8); Ile (−1.8); Tyr (−2.3); Phe (−2.5); Trp (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions may be based on the relative similarity of the amino acid side-chain substituents, for example, their hydrophobicity, hydrophilicity, charge, size, and the like.

As indicated elsewhere, variants of gene sequences can include codon optimized variants, sequence polymorphisms, splice variants, and/or mutations that do not affect the function of an encoded product to a statistically-significant degree.

Variants of the protein, nucleic acid, and gene sequences disclosed herein also include sequences with at least 70% sequence identity, 80% sequence identity, 85% sequence, 90% sequence identity, 95% sequence identity, 96% sequence identity, 97% sequence identity, 98% sequence identity, or 99% sequence identity to the protein, nucleic acid, or gene sequences disclosed herein.

"% sequence identity" refers to a relationship between two or more sequences, as determined by comparing the sequences. In the art, "identity" also means the degree of sequence relatedness between protein, nucleic acid, or gene sequences as determined by the match between strings of such sequences. "Identity" (often referred to as "similarity") can be readily calculated by known methods, including those described in: Computational Molecular Biology (Lesk, A. M., ed.) Oxford University Press, N Y (1988); Biocomputing: Informatics and Genome Projects (Smith, D. W., ed.) Academic Press, N Y (1994); Computer Analysis of Sequence Data, Part I (Griffin, A. M., and Griffin, H. G., eds.) Humana Press, N J (1994); Sequence Analysis in Molecular Biology (Von Heijne, G., ed.) Academic Press (1987); and Sequence Analysis Primer (Gribskov, M. and Devereux, J., eds.) Oxford University Press, NY (1992). Preferred methods to determine identity are designed to give the best match between the sequences tested. Methods to determine identity and similarity are codified in publicly available computer programs. Sequence alignments and percent identity calculations may be performed using the Megalign program of the LASERGENE bioinformatics computing suite (DNASTAR, Inc., Madison, WI). Multiple alignment of the sequences can also be performed using the Clustal method of alignment (Higgins and Sharp CABIOS, 5, 151-153 (1989) with default parameters (GAP PENALTY=10, GAP LENGTH PENALTY=10). Relevant programs also include the GCG suite of programs (Wisconsin Package Version 9.0, Genetics Computer Group (GCG), Madison, WI); BLASTP, BLASTN, BLASTX (Altschul, et al., J. Mol. Biol. 215:403-410 (1990); DNASTAR (DNASTAR, Inc., Madison, WI); and the FASTA program incorporating the Smith-Waterman algorithm (Pearson, Comput. Methods Genome Res., [Proc. Int. Symp.] (1994), Meeting Date 1992, 111-20. Editor(s): Suhai, Sandor. Publisher: Plenum, New York, N.Y. Within the context of this disclosure it will be understood that where sequence analysis software is used for analysis, the results of the analysis are based on the "default values" of the program referenced. As used herein "default values" will mean any set of values or parameters, which originally load with the software when first initialized.

Variants also include nucleic acid molecules that hybridizes under stringent hybridization conditions to a sequence disclosed herein and provide the same function as the reference sequence. Exemplary stringent hybridization conditions include an overnight incubation at 42° C. in a solution including 50% formamide, 5×SSC (750 mM NaCl, 75 mM trisodium citrate), 50 mM sodium phosphate (pH 7.6), 5×Denhardt's solution, 10% dextran sulfate, and 20 µg/ml denatured, sheared salmon sperm DNA, followed by washing the filters in 0.1×SSC at 50° C. Changes in the stringency of hybridization and signal detection are primarily accomplished through the manipulation of formamide concentration (lower percentages of formamide result in lowered stringency); salt conditions, or temperature. For example, moderately high stringency conditions include an overnight incubation at 37° C. in a solution including 6×SSPE (20×SSPE=3M NaCl; 0.2M NaH$_2$PO$_4$; 0.02M EDTA, pH 7.4), 0.5% SDS, 30% formamide, 100 µg/ml salmon sperm blocking DNA; followed by washes at 50° C. with 1×SSPE, 0.1% SDS. In addition, to achieve even lower stringency, washes performed following stringent hybridization can be done at higher salt concentrations (e.g. 5×SSC). Variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

As will be understood by one of ordinary skill in the art, each embodiment disclosed herein can comprise, consist essentially of or consist of its particular stated element, step, ingredient or component. Thus, the terms "include" or "including" should be interpreted to recite: "comprise, consist of, or consist essentially of." The transition term "comprise" or "comprises" means has, but is not limited to, and allows for the inclusion of unspecified elements, steps, ingredients, or components, even in major amounts. The transitional phrase "consisting of" excludes any element, step, ingredient or component not specified. The transition phrase "consisting essentially of" limits the scope of the embodiment to the specified elements, steps, ingredients or components and to those that do not materially affect the embodiment. A material effect would cause a statistically significant reduction in selective expression in the targeted cell population as determined by scRNA-Seq and the following targeted cell population/enhancer pairings:

astrocytes: eHGT_373m, 3xcore eHGT_373m, eHGT_375m, eHGT_379m, eHGT_372m, eHGT_384m, eHGT_386m, eHGT_390m, 3xcore eHGT_390m, eHGT_371m, eHGT_383m, eHGT_374m, eHGT_381m, eHGT_382m, eHGT_387m, eHGT_388m, eHGT_376m, eHGT_380m, eHGT_385m, eHGT_371h, eHGT_372h, eHGT_375h, eHGT_376h, eHGT_377h, eHGT_381h, eHGT_382h, eHGT_383h, eHGT_384h, eHGT_387h, eHGT_388h, eHGT_389h, eHGT_390h, eHGT_357h, eHGT_495m, eHGT_497m, mscRE1001, mscRE1002, mscRE1003, mscRE1004, mscRE1005, mscRE1006, and mscRE1007;

L1 interlaminar astrocytes: eHGT_267h, eHGT_268h, eHGT_269h, eHGT_270h, eHGT_271h, eHGT_272h, eHGT_273h, eHGT_274h, eHGT_275h, eHGT_276h, eHGT_315h, and eHGT_316h;

oligodendrocytes: eHGT_391m, eHGT_398m, eHGT_402m, eHGT_409m, eHGT_396m, eHGT_393m, eHGT_399m, eHGT_400m, eHGT_405m, eHGT_406m, eHGT_410m, 3xcore eHGT_410m, eHGT_397m, eHGT_401m, eHGT_403m, eHGT_407m, eHGT_408m, eHGT_392h, eHGT_393h, eHGT_394h, eHGT_395h, eHGT_396h, eHGT_397h, eHGT_398h, eHGT_399h, eHGT_400h, eHGT_402h, eHGT_404h, eHGT_405h, eHGT_406h, eHGT_407h, eHGT_641m, and eHGT_408h;

microglia: eHGT413m, eHGT_414m, eHGT_415m, eHGT_416m, eHGT_417m, eHGT_418m, eHGT_419m, eHGT_420m, eHGT_421m, eHGT_423m, eHGT_428m, eHGT_429m, eHGT_430m, eHGT_411m, eHGT_412m, eHGT_422m, eHGT_424m, eHGT_425m, eHGT_426m, eHGT_427m, eHGT_411h, eHGT_412h, eHGT_413h, eHGT_414h, eHGT_417h, eHGT_418h, eHGT_419h, eHGT_420h, eHGT_423h, eHGT_424h, eHGT_425h, eHGT_426h, eHGT_427h, eHGT_428h, eHGT_429h, and eHGT_430h;

pericytes: mscRE1023, mscRE1024, mscRE1025, mscRE1026, mscRE1027, mscRE1028, mscRE1029, mscRE1030, mscRE1031, mscRE1032, mscRE1033, mscRE1034, mscRE1035, mscRE1036, and mscRE1037;

SMC: mscRE1038, mscRE1039, mscRE1040, mscRE1041, mscRE1042, mscRE1043, mscRE1044, mscRE1045, mscRE1046, mscRE1047, mscRE1048, mscRE1049, mscRE1050, mscRE1051, and mscRE1052; and endothelial cells: mscRE1008, mscRE1009, mscRE1010, mscRE1011, mscRE1012, mscRE1013, mscRE1014, mscRE1015, mscRE1016, mscRE1017, mscRE1018, mscRE1019, mscRE1020, mscRE1021, and mscRE1022.

Artificial means not naturally occurring.

Unless otherwise indicated, all numbers expressing quantities of ingredients, properties such as molecular weight, reaction conditions, and so forth used in the specification and claims are to be understood as being modified in all instances by the term "about." Accordingly, unless indicated to the contrary, the numerical parameters set forth in the specification and attached claims are approximations that may vary depending upon the desired properties sought to be obtained by the present invention. At the very least, and not as an attempt to limit the application of the doctrine of equivalents to the scope of the claims, each numerical parameter should at least be construed in light of the number of reported significant digits and by applying ordinary rounding techniques. When further clarity is required, the term "about" has the meaning reasonably ascribed to it by a person skilled in the art when used in conjunction with a stated numerical value or range, i.e. denoting somewhat more or somewhat less than the stated value or range, to within a range of ±20% of the stated value; ±19% of the stated value; ±18% of the stated value; ±17% of the stated value; ±16% of the stated value; ±15% of the stated value; ±14% of the stated value; ±13% of the stated value; ±12% of the stated value; ±11% of the stated value; ±10% of the stated value; ±9% of the stated value; ±8% of the stated value; ±7% of the stated value; ±6% of the stated value; ±5% of the stated value; ±4% of the stated value; ±3% of the stated value; ±2% of the stated value; or ±1% of the stated value.

Notwithstanding that the numerical ranges and parameters setting forth the broad scope of the invention are approximations, the numerical values set forth in the specific examples are reported as precisely as possible. Any numerical value, however, inherently contains certain errors necessarily resulting from the standard deviation found in their respective testing measurements.

The terms "a," "an," "the" and similar referents used in the context of describing the invention (especially in the context of the following claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein is intended merely to better illuminate the invention and does not pose a limitation on the scope of the invention otherwise claimed. No language in the specification should be construed as indicating any non-claimed element essential to the practice of the invention.

Groupings of alternative elements or embodiments of the invention disclosed herein are not to be construed as limitations. Each group member may be referred to and claimed individually or in any combination with other members of the group or other elements found herein. It is anticipated that one or more members of a group may be included in, or deleted from, a group for reasons of convenience and/or patentability. When any such inclusion or deletion occurs, the specification is deemed to contain the group as modified thus fulfilling the written description of all Markush groups used in the appended claims.

Certain embodiments of this invention are described herein, including the best mode known to the inventors for carrying out the invention. Of course, variations on these described embodiments will become apparent to those of ordinary skill in the art upon reading the foregoing description. The inventor expects skilled artisans to employ such variations as appropriate, and the inventors intend for the invention to be practiced otherwise than specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

Furthermore, numerous references have been made to patents, printed publications, journal articles and other written text throughout this specification (referenced materials herein). Each of the referenced materials are individually incorporated herein by reference in their entirety for their referenced teaching.

In closing, it is to be understood that the embodiments of the invention disclosed herein are illustrative of the principles of the present invention. Other modifications that may be employed are within the scope of the invention. Thus, by way of example, but not of limitation, alternative configurations of the present invention may be utilized in accordance with the teachings herein. Accordingly, the present invention is not limited to that precisely as shown and described.

The particulars shown herein are by way of example and for purposes of illustrative discussion of the preferred embodiments of the present invention only and are presented in the cause of providing what is believed to be the most useful and readily understood description of the principles and conceptual aspects of various embodiments of the invention. In this regard, no attempt is made to show structural details of the invention in more detail than is necessary for the fundamental understanding of the invention, the description taken with the drawings and/or examples making apparent to those skilled in the art how the several forms of the invention may be embodied in practice.

Definitions and explanations used in the present disclosure are meant and intended to be controlling in any future construction unless clearly and unambiguously modified in the following examples or when application of the meaning renders any construction meaningless or essentially meaningless. In cases where the construction of the term would render it meaningless or essentially meaningless, the definition should be taken from Webster's Dictionary, 3rd Edition or a dictionary known to those of ordinary skill in the art, such as the Oxford Dictionary of Biochemistry and Molecular Biology (Ed. Anthony Smith, Oxford University Press, Oxford, 2004).

SEQUENCE LISTING (376 sequences)

SEQ ID NO: 1 - protein, 4 aa, Artificial Sequence
  Change from AAV9 to PHP.eB
SAQA

SEQ ID NO: 2 - protein, 11 aa, Artificial Sequence
  Change from AAV9 to PHP.eB
SDGTLAVPFKA

SEQ ID NO: 3 - protein, 7 aa, Artificial Sequence
  AAV-BR1
NRGTEWD

SEQ ID NO: 4 - protein, 7 aa, Artificial Sequence
  AAV-PHP.S
QAVRTSL

SEQ ID NO: 5 - protein, 7 aa, Artificial Sequence
  AAV-PHP.B
TLAVPFK

SEQ ID NO: 6 - protein, 7 aa, Artificial Sequence
  AAV-PPS
DSPAHPS

SEQ ID NO: 7 - DNA, 341 bp, Artificial Sequence
  eHGT_373m
actgatcagccatgccagctgcccaggcattttcaatgatccctagctttggctttggccaggacactcaactcttgtggacactggccctgtgtcctgcagcaaaaggggagccttggcctcttttccttttatgcaaaagttcttttaaggcagcgctctggcccagtgggcaggcagctggagtcctctctgttcccggcaggggcactcttcaagggttgtgccccagctccttcagcagctggaaggctggttggcttttgtttgctttttctttccttttttttttttttttttccacttccatcccttaccccaaacatttctctgaaggaatg

SEQ ID NO: 8 - DNA, 322 bp, Artificial Sequence
  eHGT_375m
agatatctgacaatgagcagaagcttgtatagagtgtataaaacaagtttccccttcttattttctgctttaaaacgcacaatctcccactcccagcctcttctgtccagtctatagagttaaaattgaccactgctcgtcctgagccacttcaaagtaatttagtccagaacggaaggcttggcgcttggacaatcttcatggtgtgttaagatttctatggcaattggcaagcaagacgttcccatctgaatatgtctcaaagaaagccacttattgacactaagttggctatcatcaaagacttcatcttccctctgca

SEQ ID NO: 9 - DNA, 557 bp, Artificial Sequence
  eHGT_379m
accttgatgacgttgctcttccaatactggaattaaaatgaccagcttcggagcagtaaatacaacaatggagatcacacagttccaaccctaaagcacccactcaccatcctgctttgtcaagaactgagctgtttctagggtacagggcttgtgtttttcaaacagtagttgtgaccacattcagggcaagttgaacaaccctgagccagaattctatggcaactggcagcccttccccatcagcctgaagaggtctattctctaagcataaagcacacatgacagggctggtcaccttccagtttttcaagccttctccttgctgacctggccaacaagaatacttgttggctgtgaacggtcagaacatacacaattaagtacaagtgaaggtggggaccatgtatatttgacaaaagggtcttcagagaactctttgatgtctacatcaggggtttctaacctgagatagagggtgaggggcatccatgaatttgaaggggaagattgcatctatcatgacttatacccatatttaccccaaatacacttcc

SEQ ID NO: 10 - DNA, 216 bp, Artificial Sequence
  eHGT_372m
aaggcactgtggcataccctatgctgggctttattcatcagggagaaaggtatccccttttattcatggatctgcaacaagacttagtgtcatttcatccaattttcatagaatggccagtccactcggcagggctatgtaaaataagaagaaatctccagggggtgtttttatatgtggaaccagcagagtcctggcacgttaggaagcaaacga

SEQ ID NO: 11 - DNA, 428 bp, Artificial Sequence
  eHGT_384m
agagcctaaccaggtccacctggaaaatgcgactaggctcagcacaagctgtgctgcactgtttgacctggcaggccttcaattttggggggctgaattgagtctgcttttgtttctcagggagcctggaagaaagaggacttgttacagaggaggaggggagacaaggaaggaacgagttaagccctaggcagcatcagcatctttagttctttttctttttctctcttttcaaatgagtacaccacattgaatagcgtgtggaaaattggtctttccattgaatgaaaacgaactggcaagcaacaaaacggataaaggagggatgccgctggatgtcatttggtttcgcgcttggtttgtcagaggaggaacccaggaggatccaatgttttaagatgcattttacctaaagctctggccctgct

SEQ ID NO: 12 - DNA, 328 bp, Artificial Sequence
  eHGT_386m
acagggctggggatcaaagggggccagcaccatgtctagagggcagagatcctgccactggctggtggcccctggttgtcttggaactccacctgctgttcatcagcagggctatgggaatctggacacacctcctctggctcagaccaatcccagctgctgctggccagggcgggcctgggccatgggatctggaggaaaggtcacttgtgactggaaggacagtgggcaggaagaaagagccaagctagagtaggggagggcacccctccttgtcctctagacttcctgttccatctcctgtccctgtagggctccagctaaaagc

SEQ ID NO: 13 - DNA, 696 bp, Artificial Sequence
  eHGT_390m
tccagaccttgaacataaaaggcattttatacccgcaattgttcatttaatgagcaattgcggagtgcaggccggttaagggattgagctatatgcactattattgcaagaagtattccgaaataccagaaataggacgtaagctctgatcagggagactgcgagcacaattaccttcttttcaaatccttctgtgacactgcgggaggaaaaaggactttgaaacttgaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggagagaggtgaatgagaagtcgctgtgcagttgcaaattctggcaaagaaaaaaaaaaagctcaccccttcctttattttgtaatatgcattcctgtacaatcctgccagtggcaatctgtggagttcagtgtgtccctaagtcaatatggagtacttggtttatagcaactcttgttaagtttgtcttgtaattgaagctgctgttgaccttgcttgggg

SEQ ID NO: 14 - DNA, 313 bp, Artificial Sequence
  eHGT_371m
attcaggaccagggccacagctgctgcctctttcccctccagccatggtctgagctctgagaattctagatgggccatggcagtgagcttgggaaagattgccaggaagacgctgagacctggctcccaggagagaggtgtgaggcactggctggaagcccagtgcctggctgccctggtttcctggggcccagacatgcgtgattagtccacagcaaaagcctggccagaagtcagagggggaggggaaggcagggggaggatgctctgagtttggcagggagagaccaaaacagagtggggctgggatgag

SEQ ID NO: 15 - DNA, 520 bp, Artificial Sequence
  eHGT_391m
aggtttgccctacctgtgggaacccagctgaagagggtctgtccataggttgggtagatttgccctggacaagaacgaagaatgaacttaaaacccccaaacctagagttggtttctaagctacttagccaataagctcttcgtgtgtgggactgctgtgactactgctctgtgcctagctccaccaccaacaaatatttccatgaacaaggcccatctctgtctggggacaagcatgtctttgtgatctgccaacctcctgaccacccacagcaggccattcaaacacagggcttcctataccactcagaagaggctttcccgtctttcttagaaaaagatataaaatagttgacttctcaaggtaattggaggaatgacagagaagctgagatgtcccttctacctgggtgacccagcacaagatgcacacttaacctggggacagtgatgcttagccaaagtggctaaatctctgtgcaaatcccatgaagggaccctggacatgggtgaatgccga

SEQ ID NO: 16 - DNA, 502 bp, Artificial Sequence
  eHGT_398m
tcacagccctcagtgactgctcctccactacactatcgggaaactgaggcccagggtggccacatgacccttcctggggtctcccctcactcggggcacagctaggcagatgagggcatgcagaacttggcctagcatagcctggcctagctcaacctccacccccatcctggcccttctccctacactgaaagagactttatggggataagaagtcacccattgtgtcacaggagacaaaggggcaagagacacaggctccaggcgcctgggctggccataccaccaccacacaccacccctctctgtgccaaaggagggctggtgaggcaccttggaattcctgcactggatattttagaacatggggcggggggaggtacaccatgtctagatctccaggaagcccaaagccaccaagctgtccctttctctatctgaaacagacacacacgagaaaccagagtcactcaagccagcacactctctcccaggaccggtt

SEQ ID NO: 17 - DNA, 380 bp, Artificial Sequence
  eHGT_402m
gcttagagaagggcctggcacacagtaggtccccctgctgggctagatgctattggtggtggctttttggtgcttgccttcctcctgccccaccctgtgctgtctgccactgtttgcacattgtatggttcttttcatgaggaatgtttcaaagagcatgacagaatcttacaacaatcagcccattgtctgtgtgctccagagccgactctgaggtcctggggtggccggaggctgtcagggaagggaatggggagagaggaggcgaggcttgggtgggcagtgttctgaggggattgattgccctcgggagttgtggttcttgtgtcagaatcaggccttttgttcaggtctttttatgcacaagctatttgggaccc

SEQ ID NO: 18 - DNA, 489 bp, Artificial Sequence
  eHGT_409m
tgcctctcaacttctgggctttagttcctagccttggactggagaacaagactccccaagtcccagtctcagatctgccacttttcctgtttataggatgaaaaacacagtttcccctgaaggacaaggagactcaaaacatggagcgtcccagccttctccgggcagtcctagactctgtttgtctttacagcagtgatcttagctcagataaggtcatgttttgtttttgtcttttgtcttcctgcttgttccagtcggtcccagtcttttgaagtgggactggctgggaggtcacaatgtccctattgtctaggatgacacttctgggcttaggtcatgtgtccagtgttcagaggaacccagagccaaaagaatcagacactagaactatcagtggcttaattgttctgcccttctctccagggctactgacaaggtaagtgtctgtgcttacagaggcctgtggtggcagaatagctgagccct

SEQ ID NO: 19 - DNA, 713 bp, Artificial Sequence
  eHGT_413m
tcatgagactcccctgggggagaagagagagtcagagagtcagactgtcatgcccagagagtggctggctcctacccccggaaatgggcctcttactgtgactgccctggggccagccgaacagctgcgttggccgagcaggaagtggtgaacaggctggaccctgttccagcacgttgtgggggaaagaaagaaaaaagaaaaaaaaagttccatcagagaaactgcacgctagcttaggccaaggctgatcactgacctcctgtgtggtacaatcgatctggaccaaccacttcccccttattcttccccgtatgggaaagtcggtgcaggtgcgcagggccacacaaagcagcttgggagatagcagcccaggaaaaataattccacctgtaaacacctgtgttaacaagtgctgtatttgttcagctattttctttttcaaacactgtttacacacacctattctcttacctcggtcaggtgtgtcttgcatggcatctggggacccactggcaggagtccagggtgcctcagaaatgcctgtgtcctctgcccagcaatgtagggctgggactgccaggctctcagctggagtgccagtgctgctgggtcagcctcttggaatgctttcaggtccctaggtgcttaaggttgggagacttcacgtgaccagaagggcctgtccgggggacagtgaccccagctggatg

SEQ ID NO: 20 - DNA, 363 bp, Artificial Sequence
  eHGT_414m
gctgccccttggggtcttttaagctactgaaaactctgtggagacagcaagtcaaaggcctcctacagacgggaagcagaagtgatgctgaagggagccatgggggcacctgggactgttcaatgccgaaagtgactggattgaaagaagcaccagaaagacagggaagacctgaagtcacctccctgtcctctctagacaccggaatcttcagctaagagaagtgaatgtatgagacaccttctcttcctcatgggtctgaagagatattgagaggacggaagctagacacagtctgcaggagggacagatggattcaaaggggcaggtctcggaggctacgtgacaaggtctggtgcctgg

SEQ ID NO: 21 - DNA, 484 bp, Artificial Sequence
  eHGT_415m
aaagcctcgggtctctgtcccacctagagatttcggtctctagaaatggcagccacctgctcacaccccaggcacccttactccaccccgagattctgacatcaccttctgctgtgaccaatgaatggagtcccagcaatgatgaggatgtgaatgccagctacctcccccacccgaggcctgtggttgcaaagatgctctaacaggaagcgggtttgaggagctgcacagcttcctgctccccctcgagctgcacaggacgagaagggctagcgctcagcttggccacgagacacagcttcatgccagggttctggtagcttcctcttccatatctacttccgtgtggccccaggggccccccagaggcaagcgctgctgtcccttgcccaggccaccctccacctccagtttggagccctgccccccctggggctgggccaagcccaactactgactgggattccatgggggactggtaggt

SEQ ID NO: 22 - DNA, 345 bp, Artificial Sequence
  eHGT_383m
agggaaggcagcagtcttggcaccaccaggagactatgcagacaagagctggggttcaggccaacgaggaatcaaggacttaagagaccaaggtcgtttaaaataaagaggcacagagaaggaagcctggcattctctggtaatgcaccttaggcatgggccaattcttcattgagcaatgtcagaggttaagaagctcagtaaactgcagctgaacagagaagtgagatctggcaatctcacaacactgagtaaacagaaatcggaattcagggctgccaaggagaaagaggtcatttgtaaacactccagcctttttagtttgtctgggtccttggcaaagct

SEQ ID NO: 23 - DNA, 292 bp, Artificial Sequence
  eHGT_374m
gatgggtgggaccaggaagggactgggcaggagctcattttgggataggggaggggacagctgaggggttacagatggagtaaagcaaagcccaggcatcctatgggaggtctggctaaaagccagggtcctacttgcccccacgctccacccaactcaatccctgccccttagacctcctcccaccagggggctggctacaccccagtaagttttaacaaggcacccctccccttggcaggactcacagggaaggttttgtcttgctcagcccagtttctccagcgcctct

SEQ ID NO: 24 - DNA, 320 bp, Artificial Sequence
  eHGT_396m
tccatggcttccacagtcactctgcctagttctctccccaccactcagttggtaccactgggccccaaggcagcaagagagtcaatggctccttttctctgtgagtgtgatggatctggggtgggggaggagatgtccaatagctgtctttgcagcagccatagacacaatgtacaaagcccatcttgttctttagcctgagcttcaggtccaacaatatacactatggggacaggagagcaatccccagctacagctatctatctgcagggatgcttgacattctgctctgggtaacagggctagggttgttcagctga

SEQ ID NO: 25 - DNA, 242 bp, Artificial Sequence
  eHGT_381m
cagggctgtctcagttgcctaggaacacttagttaatagtgattccttccagggcgcttcagttcactgctgacctcactgatgatgagtagttgaacaaataagggaaagaacactagagacgtttttggcttctctttcactgaaagcatggaagaggccaagaagtttttgcccacggagtaggaaagaaagtaggacatggaaacatcttttatcaagcttcttacaattgagccttc

SEQ ID NO: 26 - DNA, 479 bp, Artificial Sequence
  eHGT_382m
ttagcgggcaaaggacgtttatttgatgaggggtaggagcttggtcaattctgtgatccctagattagattgttgggcagacacacccacttttcagagaggccattggctcctgtgtgaaagatactcccacagcaaatgggggagggctggcagcctcatttggctttctgccatctctcagagctgggtcctggtgtgctttggggaagcgtctctggcagatccctgctagctagtgtttcctgacatttgtttcagagaccttaataaggttactggaaaaaaaattttctctcttaaaataggttcactaagctctgggttctgccaggcaagtaagtctttcactgggtcttggatctgcagggggcttcagaccccttccagaggaggggttgcctctgcagaggtctactgagcagaaagggacaagatgggaaccttctttgtgaagctcacttggtttcagcacctgc

SEQ ID NO: 27 - DNA, 492 bp, Artificial Sequence
  eHGT_387m
tggctctggcaaaggatggagattttttttttaacctattcttttgagaataaggagggtctttgtttctcttccctgggaaccgagcagcccctttctctgagggtagagttggggcatggctcagcagaacgacagtcatcctggctagtaagactcagaggctggccttcaaaggcttgagctcctgggtgactgagcagtggagaaacagaatcctgcccttgaattgctccccaggcgggctttatgcagtctggggaagcaagggatgccctgtgattcttaaagaaactggtataattttgcactgcatagcagactcccaagacacacagccttttccaggaggagttccttagaggggaaggggataggttgcaatggtctgcttagcctcccgaaggctgcagaagctgctaagacaggggtaactgaaagatagactctgtgaggttgaacagcaatctttatgacctgaccccctaggca

SEQ ID NO: 28 - DNA, 434 bp, Artificial Sequence
  eHGT_388m
actggtgagtgagttgtgcagtttgcaaaacttggaggtctccctggaaacagaataaaatgctgcagtgtgatgtccagagggagggggcttttatcccacctcataattaaatctgaaaggttcctggggcgagctaagaggtttctaatgaagtactaagctgtgcttggagtctgcaccacgaaaggcgctttgttctcctttcaaaaggttccagtgctgaataatttggctcccagcgctggctagtttcagaccacctgcagattctaatctacgcaaatttatttggtacaaactttcttctacgtcacttggttcagcataattccagagaggtttattgctaatgtttaacagccatcagagaacagctgctctcctggggcctgcccctcgaaagggaaaaaggggggaaatggggcttttgt

SEQ ID NO: 29 - DNA, 595 bp, Artificial Sequence
  eHGT_393m
tccagaaactgagtctgcagcttcttagcagttacttgagaaaagaagtagaagaactgatttgcttttacaggcttctcagcagaatctccgtggattactgtgctgggcttttagtagcacaacacgtcagtatgtcagtgcttactcaatgctattttcggttctccaagtaaaatcatgaacactgagccttttgttcaaagtaccataagggcattctgatgtccgttcttagtctgaggttaaaatggagacagctaaacaagttgtaagatccaactttctctctctctctctctctctctctctctctctctctctctctctctcaatctctctctctctctctctctctctctctctctctctctctctctctctctctttctctctttttctccctcccttcccttcttatttttcgtgttttgtatttttttcctaacaacaaacaaaaggaagtactcacttgaggtgaggacaaggctacttatgtaagagttgtgcaagtggagaggacatgccccctgcttggagattagtccagcaaacaaatgatcaatttaaagcagggacaaaagttactgaaagg

SEQ ID NO: 30 - DNA, 281 bp, Artificial Sequence
  eHGT_399m
tcctccctgtcagtgacatcacttgaaaagcccaacaatgcccgcacacgcttggatttcacgtctagaatagtatctgtgtagccgacctcctggagatacctgcacaaaacggatccttatagttcagtcacacaggaattagtgttgtaaaatttaaaatgtaaataaaaatatttctttaagctcactgactatataaggtttaagagaacagtgccatgtcagtaaggcttgttaataatattccagctgcagatggagctgtctcttgcagtacc

SEQ ID NO: 31 - DNA, 418 bp, Artificial Sequence
  eHGT_400m
tggtgcgacagaaatatggctaaagctagttttgttttaaatagaacatggatttctatgaaagaattatattgataaattattagtagcaagttaagataaattgttaacatttgtctactttatgcactaggcacaaatacttattaatgaaacccctcatgtgtgaagattatttatttatgtttctcaaacaaaaatggtattgtatccgattcactgggtgtgctttgtccagtctgattttctcattagcaattctctgcatgattaaatgctaaatacacagctgtgtaaagcctcaactggtagtaaccagtagtgcctaatactgctgtcttaaaggaataacaatatagtcaaatactggatgtacaagctttaaggccccattcagctgaaagacctggggttatca

SEQ ID NO: 32 - DNA, 361 bp, Artificial Sequence
  eHGT_405m
tcctctgtgcaaccctctgctctgtctggtgtgatacacagaggttctacacaactgggctatgatgggacaaaacaaggctccactcatagcaactgcctgcccgctctgtgcataaagaaagggttctctgtgttgtagcattcttgcctgtcagctgctcaacaaacagatgttcatgttctgctcagagttctggctaccccaggtccaggcaaggcacagagtagtggggataactgcagaggaagggagaaggggtgagttgggcttcccatactgcacacttttccttcccctgatgctgtttgagagtgagcctcacagtttcacctccagcagcccagtgcagccaagttta

SEQ ID NO: 33 - DNA, 320 bp, Artificial Sequence
  eHGT_406m
gggagtcccaaatgtattcaatcctgacacttaaagagaaatgtggcttcgtttctaaagagccattctcaatcctatagagctgctttctagtagatggaatacacaagcatctgcctgtgtctggtagaagcctagaaagtagacaatggttctattcaggccaagcacttcccctccaacaggcatctaagcagcactgtgttagggagatgactctgacatgccctgaatagatgaccggtttggagcacctgccctgtggactgtgacagcacaagccagggatactgaatcttctggcctatgtctactgctct

SEQ ID NO: 34 - DNA, 295 bp, Artificial Sequence
  eHGT_410m
gcactccagatagaaaggcccattgttttctgcatctgaagttaacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcaaaaatcaacaaataaagctttatctttccaatcctggactcacccact

SEQ ID NO: 35 - DNA, 349 bp, Artificial Sequence
  eHGT_416m
ggactgagagccccagttcctagacgccccccagccacaaaacggggggcccggttggagtggagtttctaagaataaagccacttccagagcgggcagagatcagggactttcaggccagctccatccaagggtgagctcaggcaggcccggctggccgggatgggaagggctgaccacttcctgctcagggctggcggtcccccgcagtcatcagaagccaaccacttcccggtctgggccgccttcccctttctagccaagcgggagggtagaggatgaggtggccctttgcgtgctgtggcctgggcgactctggcctcttttcatttccccactatcgctgcgt

SEQ ID NO: 36 - DNA, 300 bp, Artificial Sequence
  eHGT_417m
  misc_feature (22)..(22): n is a, c, g, or t
  misc_feature (25)..(25): n is a, c, g, or t
actgagaaaaatgattgggccnctntttttttttttttttttttacagagagctaatcttgaaatcagaatctgtaggtagtggaccttcaatgatcactgtttcaaatcgagatgtgactttaaaaaaaaaaaaaaaaaaaaaaggaattccagacagctgactgtggccaacagcagctgtgtcacatgctggtctgaggaagtggtcagagggcaagcaactctatattgcattttctttgcagaatggagccctctgcagctgagtgaacccaggggctggacgtgctcaccctat

SEQ ID NO: 37 - DNA, 370 bp, Artificial Sequence
  eHGT_418m
agctctctgtcctagcacagtgcatgacaacaaacaggcaaagaagatgttgaaaaagatgcacacagaatggatgaaagtttgcaaagctctctctctccctccgagtttttctttttttctttttccaagatcttccagaaaaaaaaagcagaacctttgaccagacagagcaaacatgtcacagagttctgctttcaccgtatgttaagtggaaatgattgggcaagtgagttgtaagcgattcctctccgagtttcctctgagctgggggttgatcctgcgcactcagactgacagtgcaaagtgtgaaggcttgcgctcagcactctcaagtcccaccgtgcctcagctaccttccatcgtgggc

SEQ ID NO: 38 - DNA, 484 bp, Artificial Sequence
  eHGT_419m
caggaacctggtgacatgggaaccagggcccaaaagatatggggtggggcagttccctaaccagtctgtcacgctagcctttccactggcagccgggcctggtttgtagttccatccagcacttgtccaggcccacaggctggggcctcccctccctccccaaagccccctccccagggcctgtttcccggaggagctggggtcttccccagaatccatgattcactcaagctggggccttttcacttctgctttggagctaaaaatatagagaccaaggagtcttgttgagcaggcctccccacacattgcacaatatcccccctcggcccctccccagaacagctagagagctctgctgacgcagggtccaatgtggacccaaacttctcctaggttgtctgtgctgaggtcagggcttacgttcacgcgctgcttttgtgagccagaaagtcccttcctgtagccctagtaacccaggcat

SEQ ID NO: 39 - DNA, 416 bp, Artificial Sequence
  eHGT_420m
agcccagactttgccttcctcccaggatccccgaggcctcacccttcctgtgcgaacttgcagacttccctaactgccactagggaccacaactgcctgactcacaaccaacaggaagcaggctgtgaggggccaggtgaaatgaagtcaaagacacaggaaatgctctgagccagatttctatcattgccccaggtgatgtcctttgcctgagttagctaactatacaacccagcatcctccccaggtcgaggcagagctcagataccatctgtcccaatctctcacccaaataataaattctgaaggaaacattcctgcagctcagccaggcaacttctgcctgtttgtagaagcccttgagaaacatgtggacagactcactcctctcttgtgcaagctacactgccttgggg

SEQ ID NO: 40 - DNA, 377 bp, Artificial Sequence
  eHGT_421m
acagggtcccacaagccaaactgaccattctcatcagcgcagaagaactaacatgtgaccaccatgggaggtaccccatctctaataccagttaatcagagtagaaacatttttcaccttggccattaaggcagatattttgatcattctgttcttagtcacaaacctcattacatttacagtaatagaagaagaaaagagagaaccaagggaaagccctactcttctatcaggtttccccgtaaacgtcacttctctcaggaagccagtcagacagatctaccccaaccgacttcccctggctcagctcttctcactcattacattatcccttccagaatgatctttaccctctagtccccaacacattccccagc

SEQ ID NO: 41 - DNA, 297 bp, Artificial Sequence
  eHGT_423m
acctggatcccccgtgtttctgtggcctggcctcctggttctggggctgggcagggaggtagggaggacctgcccattgttcccatgtgccaggtgagtcaacgccatgttcccagctgcacccactccattcctctaccctgaccttaggaaaggaagaccaagcagtcttgtaaaacatttgctcaatccctcagccacagagcttactacacaactgcctgcgtggcttctttggccataacgcttctgtgccacctttagctctgcattgcagcccagtgcacacagctcagt

SEQ ID NO: 42 - DNA, 213 bp, Artificial Sequence
  eHGT_428m
ggtgtgctcttggactccctctcacgtaactttttttttatcaatgactagtattagaaaaaaaagattcattgacacagtaactgaaagctgactgggaaatgagaactaagaagaggaagtcatatccacagtggctaggttagagccacaatcaaattagagaagcaagtcttctgggcaggcgaaaacaaatgaggggaggacgggtct

SEQ ID NO: 43 - DNA, 525 bp, Artificial Sequence
  eHGT_429m
ggagagtgacctgactacaccagaacacatgagtgacatgctgaggattttgttccctgataactggcctggtctgtacatggaccatctcgggctattttatctgagatcattggaatactctctcctcttgccatgactaatgcttttctatctctgaaatatgacttcctttttgttgattcatgtaataaacctcagagtgccttgcagggtgtatctagtgtgtcattacacagaactggaacattctctgatgtgactagattaacagtactaacgtggtaatcactggaggtcagacatcctggggagcaggctggcctctgtgggtgtggttagcactcgtgattctggggactcaggagttagaggaagtaccattttaaccgaggagctaaagctatccctacacagagctgtccttggatttcccctgccaagtactcatgttttcaggtcttaccctcaactgtgtcctgctgctgctgcaactactacttgcaagtaagtctgggcctgggc

SEQ ID NO: 44 - DNA, 315 bp, Artificial Sequence
  eHGT_430m
ttgaacttgcagggggctcattaggtgtccagagacttttgctgatggatagcatgcactgggcatgagcctgctggctttgacattttcaaactgcacacttcctacagcgacagcgtgccaaagccatgggcctcactgccatcttctcaaaaccaggaaatgaaactggccactaagagcaagtgaccacgagccagggcattggtgcaaaccaagcaaaacacgctgtcggcagcctaggtcacaaggaggaacgcatctcatttgcagcaatctttgaagaaatggtccactcctgctcctcatcctggc

SEQ ID NO: 45 - DNA, 509 bp, Artificial Sequence
  eHGT_376m
tgacacttgcaagcagttcacttattatggaaaagcatggcttcagtggccaccagcgcagtgggaggagacctgaagaacacaaaacaattccgtcctctgtatcttcagtagagctggctccagaagagggtccagttctgaaacatggaacattctccccattgggctctctgggaaaaggcctcagtattgtagagggtgcctctagctattcaggtcttgccaaggagaacggccaagaaagacaagaggtcacatggccaggcctgcagccggcacaaaatgttctgagcaactaactgatggctggacagggaccaggactgaccctgaccctacgttgagttttctaagagaggtaggccaacacatgatgcaaaggattctattgttgcttctgcaaagcaagatttgagttaacatgagttgtatgtctcttctaaatgaagagacatgaattttttttctcatatgtacttttttaaacattgcaataacccagttac

SEQ ID NO: 46 - DNA, 503 bp, Artificial Sequence
  eHGT_380m
ggctgagccctgtactgaccaagcaacctgcagagggtgggggcgactgagggagcctggctttgggggtcagctttgtcctgttagatggagggacggacaccagaggtttggggactttccttcgtctcacttctacctgaggggtgggggaaggtagaaaggctagaatgctggttggcagggcttgagttcaggcagtcctgggaaccttgcctgaagtgcctgagacagaacagccatgaaggctggcctgaccaggctagccaaggggcaggagcagggcatttttcattcatattcctgcctctgcatggcagcccacattgccacccctgttcctgggctcccagcctgatcccaggctctgcctgccccttggcagccaccacccagcctatccacccagatactttcgaattcccatgcttctaaccgctccctggcccctgtggggtaggtgtgctgaaagaggctcaggcacaatgtggatgtgtacatgt

SEQ ID NO: 47 - DNA, 654 bp, Artificial Sequence
  eHGT_385m
gccctcccgcttctttcttgtcttcaacaagaaattaatatctcaagataactccgatgtgttggtcccagccagaacacttgaaagacacgttcaattagggccacagcattgcttctggagtgaacggctatcacactgccctggagttcagtctcctctgcacacacataaacacaagtgcacagcgccccaatgctgttgtcccctcagccttccagcactgccagttggcaaacccaagccaggaagttgtcaattccaattgcgtttaggccatgtagtcctattaaagaaggcttgctggttaaggggcatcctctgtttccaaagcatgggaaaaaagaaaaaaaaaaaaaaaggctgtgcttagattggagctggcaacttccactgactagaattttcaaggggctgtgaatgagtttaacaaaggaggtctgtggctagtttctggctgaagtccatgtcaacagtttttaaggtcacaggccacactaactaacatttattcccagcagaccctgttctaaacacaagctgtacatagtacaaatttgaaatttttctgtaatcccttgagatattcctgatccctccacatgtttctgctcaattaaaaacaattctcacttctcaccacaagagaggcca

SEQ ID NO: 48 - DNA, 446 bp, Artificial Sequence
  eHGT_397m
aagccgctttgaatgctgcatgaaacagctaaattcgttctgctcttgaatgagttcccttagcgggcaatagttttctgaggctttgaaatgatcactaatactcgagtgagtcttacagcacttctggagtggaccagagcacttctcaatacaaaccagcagatgaggtcatggtcatgcaagtcgtcgggggggggggggtggcagcaacaatcattgtcaaaggggtgttttctgtagatgagagaatgaaactattgtacaaaactcaatgggcgccaagcatgtggcccaattatttcgcctgtatgagcatggcacggaaggctctccttagagaactcaattcacacatttgtgttttgtcttgtattcatgggcaaaagcctagagactttcaacctaagaggcttcaccaagttcctgtcttttaaacctagaac

SEQ ID NO: 49 - DNA, 315 bp, Artificial Sequence
  eHGT_401m
tacggcctgggaatgcagagtgacagggttgataatctgcatggctcttccccactcaagtgctcagtggtcaacagcaacaggacaacacgggcttatgtcctgaggaaggcagctgctggggacaggggtggaacagaggcagctgggggtggagaggagcctgttaccagctgcacaatggatttctcagctaccagcaacccctctgggtgacacctagctattacagttctcatagccagctctcctcatagggcaagaagaaagtatggctccagggagtggcccctgcacacgctaatgctatgccct

SEQ ID NO: 50 - DNA, 393 bp, Artificial Sequence
  eHGT_403m
cttcaggcgctgggaagctacccagggagtcagagagccagagcaactaggactcaactctgtagagacaagctagcatctgatctagccctgttgccttgacaatggctcatatcccaggcaccctaggcacccacaggagcaattagtgagtgtgggagagggtttctatggtggcggtcccaaggacctagggaagaacaagggccagcaggacctttctcctttgtcctgagcacactaggcctttgttcttctctggctctctttgacagatgggagcaggaacatggttagggaggccaacatggtttaaagtcccccaccgatgggagccctgagccatctaggggaggctatgggaggttgaagtgcctctctgggactcagctg

SEQ ID NO: 51 - DNA, 329 bp, Artificial Sequence
  eHGT_407m
ccacattctttgctctcacctcctgacctttcgaccaggaaagagagccaccagttgctggtgctccctcccacacctagttagctgggtcctggaggcatcttcccagcggggcatctctgagcttggtggctctgcactggcagtgggccctgctcagcaaagaaagaacaatatggactctgttctcaattagtgtgtaaccctcggggcaggcacaggctcactcctgctcccctgtactttaatggcctagtctgatgttcctacagctcggggccaggtggggcaagagcccagaaacaggagagcaccttgcattccctgga

SEQ ID NO: 52 - DNA, 672 bp, Artificial Sequence
  eHGT_408m
tcggactttgcttaccgtgtcttctcatgctagattagctgttagtaacacacactagttgtctccaagaccagatggacaggaaaaccttgaattaccaccttcatgtaattccacgccagatatctcagcagacacatacacacacacaaacctcttattgctcccctgaaagggcatctgagagtagggctcctgaaaatgtgtgcagcctgtgataatggggcacacagtagacaaaagggcagaagaaaaatgaggctttaataggcacactatctaggtcatttatccttggataatgggaaaaaaacacaatgtcgtagtgtcagcaagggacacaaaggcattctggtgtcctgcagaccagagcttgatatcaagagccagtgtgtggaaaaacccacgtggaactaaaatggacccatttaagtgtgtgtgtgtgtgtgtgtgtgcgcacgcatgcgtgcacattcacgagcatgaactcacattcacccagtctcaaggactactagattattaaatcctttatttgttttctacaataaggtttaaattataagacctttttctatgtcatttcagcaaaccctatttccatctaagaaaggagtgatatacatggaattgtgcttgtcttttaccttcccataccccctttacacacca

SEQ ID NO: 53 - DNA, 358 bp, Artificial Sequence
  eHGT_411m
atcttttgaaaaaggaagaaagaagcttttgggttctttaggaaccagactcagggcagtagtggctgtgattatcagagacacctccccgacccccaattctagagtcccctcctcccagagtggcattagcttctgtcccatgactactatctggcttcccctttctcttgcacccagggtgctacagggcgtgacatacagtggggggtgggcaggggggggaggtttcctgcatctggctcttgcctaagggctccaacctcaggttcctccttctccagttctcgatcaggctcccactggggactaaaatagtcccaacctcctctcccatgatctcccctctgtcctggct

SEQ ID NO: 54 - DNA, 402 bp, Artificial Sequence
  eHGT_412m
cagtgtccacctctgccacaagagtacagcttaagcctcagcagagccagtccgagcaattaaaggggcagggccctcacagccagagggtgggccggaaaggctgggagatagcagttctgaggaagcaaacccaccctctctctctttccacatcacgcggacctggctgacgtggcccaggaagaggggacaacccgggccctgtggttgaaattctatttatactgactgttgcaagcctttcctgctggcgacaaggacgtcactgggcactgacctcaccagaatcgctgacgcatcttccctcacgctttgcctggatggtagtgaggcaggcctctcatcctctgggccactcccactgtccctctgcgtacagtaccctccactcctgtcccc

SEQ ID NO: 55 - DNA, 619 bp, Artificial Sequence
  eHGT_422m
aaacgcatttgtgggagggggaggcacaaatatcccactgaggagagagtagtttcagggttccagaggttcaaaggggctccaaggagctccgaggggctgcagggcagaaagcagaactaaggaccggtccgtgaaggtcctcttcccaggaggaaactgtagccccacaatgcctagcctcacaggaaaccacgtgatggaaaaaacacaaaactccttctggggagagagtgagaagtgaggttgtgaggtttcttcagctcggggggtgggggggagagcattttccaaccgcaaggattggggggggggtggagtggggctcagtcctcttggtccttctcaactctgtccagaggacaccatagctcaaggccttcagaggttcctaccccaacccaggcctcctgggccatcctagcccacctcaggaacaggccagagaccccaagcaatgtgagggggctcagctccttccctcagggacaggatgaggaagtctccatgcaaatgtgaacagaccacaggcagagagttcactattgaggggacaaatgcaaatttcccagaagaggaggggcaaagagaggagccattgggtcatggcttccacaca

SEQ ID NO: 56 - DNA, 397 bp, Artificial Sequence
  eHGT_424m
agtgtggcagagtgtgtggcctgggggagagcagaaggcttggaggaagggatatgcagacacccagcagggcagggctggattatggactttgtgatgacagcagattgaaaagagagagctctggtgtcttgaaaagaggaactgctctatttgggtagcttcctgggtgtaagggaaaagcaatgtcaaaagttcaggcctggggcgccttccagacccaatgccactaacagggatagggcggggtggcaggaaggagacagacttgagcgtgctctgcctcagtggactatacaatctgtttccttcacacatgcacaaagactgatgggaaatcgagtgttcacacatagaacgccaccggcctaaccagccctgggagggcacacaggtc

SEQ ID NO: 57 - DNA, 306 bp, Artificial Sequence
  eHGT_425m
tggcaagggtcagacagagctacaggttggaacacaccagctaccttcacacctgagccctagcatggctcacactgggggtgcaaggacactctcttcctcaacctcctgctggtaagctaagcctgcttcctcttctcttgctcacagccaagcagtccaaaccacaatggtgtcactgtcagctatgacatcacaaagtaccgtggtggaaaaagatgtgtgtaggtatcagagtggtaggtcccagagctgcagagcccctgtcctacataagaggtgggtcccaaaccccaaagcccctgc

SEQ ID NO: 58 - DNA, 354 bp, Artificial Sequence
  eHGT_426m
tggagtggtcatgtcctctttttatataagtaaaaattattcttctcaacagataatttgcattgtttagggcttcagaatagggaagtagttatgctaaaatcagaagagtgaaagagccaagcaggctgagagcccccttgaaaccccccaccccatgctatgcctcctctgaggaagcagcagaaagcccagcaaaatttcaggttcctcctttggggaaaagagaagttgacctcagtagtttctcttgaaagttacttatgttgtgctgcagcttgcatcactctggatacaggatggagttctttcagtcttggagttctttcagtcttggagttctttctgttctct

SEQ ID NO: 59 - DNA, 393 bp, Artificial Sequence
  eHGT_427m
ctggagccattggggaagggcaagcctgggagccaggaagccacctgcccagggcatgtgagatggcctcttcagtcccccccaccccgcccccctcccgccaatacccagccttgtcgctggtttcctgtcagtctgcactccccagggaggggaggggtggctaatctctgatgcgttgtggaggcgggctccaagaccgttgggcgccctgagatccgacccacgtggcctcggggttataagccctacccaccctgaagggaaccccactttggatccagctcttctcagctctgcagcatcaggtaagacctaaatcttcactctggcctcaaccagggctctttaattctgggcccaaggctcagagaagagcttggggtgcaggtt

SEQ ID NO: 60 - DNA, 292 bp, Artificial Sequence
  eHGT_371h
ctccctgctccccaaccgcagcctgaggtgtgagaattctagatagggccacgacagtgtgagcacatgaaagattaccaggaagaggttgaaacctggctcctgggagagagaggggtgtgaggccttggcaggaagcccagtgcttggctgccctggtttcctggggcccaggcatgcgtggtcacagtccacagcctagggctgggccaggaggacatgcctgccagagtcccgagggtgaggggaaggaagggacaggaggcgctcagctggggcagggagaaaccaa

SEQ ID NO: 61 - DNA, 263 bp, Artificial Sequence
  eHGT_372h
gaactgaacatgatgtgagatgtgtaactttcatttattcactcatgtgccaggcaccatgctgacattacatgtgaaaagtttccaaggttttcttgttacgtctacaattactgctaagtttcccgtaagtaatttgggggactggaaacgagggcaaaattacatgaagggcttagaaaactgcatcaattctttttggatgtgtcagggagatgggggtagtctttctccctgctaatcaagacccactagagcaccgc

SEQ ID NO: 62 - DNA, 327 bp, Artificial Sequence
  eHGT_375h
ggccacgttttgcctagggaagatgaagtctttgatgatagccaacttagtgtcaataagtggctttctttgagacatattcagatgggaacgtcttgcttgccaattgccatagaaatcttaacacaccatgaagattgtccgagcgccaagccttccgttctggactaaattactttgaagtggcgcagtacgagcagtggtcaattttaactctatagactggacagagaatgctgggagtgggagattgtgcgttttaaagcagaaaataagaaggggaaacttgttttatacactctatacaaggttctgctcattgtcaga

SEQ ID NO: 63 - DNA, 555 bp, Artificial Sequence
  eHGT_376h
ggggccattgagattgctggatcctgattctttgaagcatttcattcattatggtaaagaagggtttaagtggccaccaacagagagacgtgaagtacatgaaacaattaggttctctgtatctccagcagaattggccccagaagagggtcaggctttgcaaagacacagaacatttttcccgctgggctccttgggaaaaggtctcagcattatggagggtgtctctggctattcacagcttgccagtgggaacagccaagaaggagaagaggtcacatggccaggcctgctgccggcacagaatgttctgtgcagctgatggctgggcagggatgaggtttgcccgatcccctgctgaggcttcctatgaaaggtaggcctgagagttgccaaaacatattctgcaacagggtctatgaaggtcaccataaagcaggattcagactccatattagttggttatctcttctatacagaatgttatgccaagcatttctatatatattccttttgtttgtttgtttttgtttttgttttgagagggagtcttgc

SEQ ID NO: 64 - DNA, 483 bp, Artificial Sequence
  eHGT_377h
gttatcacaaagcttctagtcaaccttaatttctaccacctgaaattcagaacctaaggctattttacaatctttacaaaatttaaattatttttctcttaaaagctgggcaggttggtgggttttcttggtttattcttcaggttttttgttttggtttggtttttggttttagtccttgagctttgtaaataagttttcctgcgcctgcttgcctgtaacttatttttctggtctaatgactgttttttaatgagttcagcctgtgctttcttgtacaaaaagaaacgtgggcatgtgaggagcatattaattagctatcagatgtagcctggtttttgaagtccagatcttcaggatgttaccgaagtgtaaatataagcatgacttttgcacgtgattagtaattacatcacagttaaagcctcaggggaccttccaccccagaattctgctatcctcaacccctgaatggctctgtca

SEQ ID NO: 65 - DNA, 232 bp, Artificial Sequence
  eHGT_381h
gggctttctaaactggcctggaacactgttagttaataaacattcctttcagggttgttctctttgcttctgatctcattgatgatgatttgttggacaaataaggaagtaaacagtgcagagttttttggcttctgctctattaaaaacatagcagagaaggacaagaagttcctgcctgctaaataggaagatctagggaatcaaaagagtctctgtcaagcttcttgta

SEQ ID NO: 66 - DNA, 515 bp, Artificial Sequence
  eHGT_82h
ctttgttttcatggcatattattgggcaaagatactatttattcgatgctatgtgtgagctgggtcaggattatgaccctgagttatgtttctgggaaaatgtacccacttgtcaaagatgccgttggctcctgtgattaaggtcagcccacaatgaatgtggggagggctggcagcctctcaaatcagctcttgaccatttctcaagctggggcctgttgtgcttgggggaagagtctttggcagctcagctcggggctagcgtttcctgacatttgtttcgctgaatgttaacaaggttactggaaaaaagggttctctcctaaaataggtttagggaagcactgggatatgcgaagtgaatgagtttctttagggcaggatcttgactctgcagggggcttggaggccttccctagagtggggcttcctaacactgcagagctcttcccaggacgaggggcaagattgggacctactttggaaggttgtttttgtttcggcacctgctctgt

SEQ ID NO: 67 - DNA, 372 bp, Artificial Sequence
  eHGT_383h
gagaagccaggcagacagctgccaaagggcaggggagccagcagagcttctgaaaatatcatgaggcttggaagacaaacactggagttcaggccaagaggaaatcaagggcttgggggaccaagatcatggaaaataaagaggcatggggaagtcagcctgacagtctctggtactctccattagacatttgccaattctttattgagcagtgtcaggggttaagaagctaagaaaaattagctgaaaaggagaagagagtttttggcagcctcacaacactgggtaaacaaaaactggaattcagcactgccaaggcaaagaggtcatagtaaacactctagtcttttagtcttggaccattggcaagct

SEQ ID NO: 68 - DNA, 441 bp, Artificial Sequence
  eHGT_384h
gacgcaaagcagagtagccaacaaaaaccacttaactaggcccacctatacagtatgaccaagttgaggataagcctcactaaaatatttcacctggcatgtgttcaagttttgaggttgaatgagtctgcttttgtttctcactaagcctggaagaaagggaacttgttagggaggaggagaggagagaagggaggaatgagttaagtccttagcatctttagtgctttttctttgcttcttttcaaacaagcacaccacattgaatagcatgtggaaaattggcatttccagtgaatagaaattaactggcaaacaacaaaagggaaaacagaggaatgctgctggatgctgtttgacttgtctcatcttgtcagagaaggaacacctgtgaatcaaatgatttaagatgaatttacctacatgtttggttcctgttca

SEQ ID NO: 69 - DNA, 520 bp, Artificial Sequence
  eHGT_387h
acgcttggactaagtcggttaggaataggaatggataaataatggggcaatacaaagatccctggtcaacttcacagtctgtcatctaggtgctccggtttttaacatcttctgcaaccttcgggaaacagaacagatcatcgcaatctactgttttttttttttttcctctaagaaaatgcccatggaaaagtgctggatgtcttgcaaatctgttatcgcaatgcaaaatcacaccgagtttctttaagaatcacagtgcattccctctctcccagaactaaataaagcctgccttgggaagcaattcaaaactggaattctgcttctacattgctcagttacccaggcagctgaagcctttgaacaggtctcagaaagtccctcaaatacagtctttttaggtcaaatgagaacagtcctgttaagtcatacactaattcctctctacaaacagaagtctggttaattctcagggagctaagaaaaaaaacaaagatcctctttcttccagaaaaat

SEQ ID NO: 70 - DNA, 387 bp, Artificial Sequence
  eHGT_388h
acttggagatgtcccaggaaacagaataaaatgtttcaatatggtatcctaggaaaagaaggtttttatcccaccttataattaaatctgaaagattcctacagtgaactaagaggtttctaatgaagtactaagctgcatttagaattggagcaatgaaaggctctttgttctcctttcaaaaggttccagtacagaacaatttggctcccaatacaggcatgttttagaccacctgcaggctctaatctacgcaaatttatttggtacaaactttcttctacgtcaccttcttattcagtataattccagagaggtttattgctaacatttaacagtattaataagagaacagttgctctcatggggactgccctggaaggaaaa

SEQ ID NO: 71 - DNA, 733 bp, Artificial Sequence
  eHGT_389h
ggctcagggctccatgacatgtggcgacatgcatgagcagggaggctcatgccaccatggaagcaggtgaccctggtggccctgccaggacccagccccaaaccccttcctgggcctttggctcccagggtctcctcaatgcagcagggcagagcctgggaattggacgcagcacagcccggctcagagccagcaaagttcacactgttctttggggagaaaggcgctcagaagagatgcctgggccctttgtcctgtagcttggtaacacaaaattctcacacttgtcaaaaaaaaaagggggctatccaacacccccgcccttcctcccgggccccctacccccatgcagtgactagagctgtggtcaaggactcttcttccccaaggcagaggaggcacagtgggctgccagattgccaacccggccaggacaaaaggcctttgacagctccctgctgcggttcagcagtgacccagaggctggccctgagaggacacggctctgcccagtccctggagagtccccaggtctgctagtgaagccctgcggccctcaagccaggatgactctttccctcttggctgcaaccaaatttccaagggcctgcatgtgcgcccatctgtctactgtccaccgcagaggtgaaacgggaacatgaccccacccgcccctctgcaccctgaggtcacatccgaccagcacagtcgtgcctcaccctgcacctgagac

SEQ ID NO: 72 - DNA, 691 bp, Artificial Sequence
  eHGT_390h
ccccaagcaaggtcaacagcagcttcaattacaagacaaacttaacaagagttgctataaaccaagtactctgtattgacttaagaacaggctccactccacatattgccactagcaggattgtacaggaatgcatattgtaaaataaaggaaggggtgagcttttttctttgccagaatttgcgagtgcacagcgactcctcattcacctctctccaaccagctagccgctcagctcaattcaccccacacaaaggctggagcctagacctcaatggaccgagtgaaacatgttcaaaactaggctctctattgtgactgaatttcttaacatcttttcaaaaagcggagaatgccttgaggctaaaggaagaaacaggctaatggtgaattgggaattctgagcaaatttcagagccctttcctcctagcttttgaggttgaaagcaagctctttcctttcaagtttcaaagtcctttttcctcccgcagtgtcacagaaggatttgaaaagaaggtaattgtgctcgcagtctccctgatcagagcttacgtcctatttctggtatttcggaatacttcttgcaataatagtgcatatagctcaatcccttaaccggcctgcactctgcaattgctcattaaatgaacaattgcgggtataaaatgccttttatgttcaaggtctgga

SEQ ID NO: 73 - DNA, 503 bp, Artificial Sequence
  eHGT_392h
attcatgaattatccaaagaactgggaaattttttggttgggaggtaaatcagttacatgagcataccgctggcaaaggagtatgccatatgactgatctctgttggggggcttctgtctgttgacagagaagcagaaaaacaaaggacaaaggaaaccctcattaattaatcttaccaactaagccaaataaatggaccacttgtttcagcaacagaagcaaactgttgacaattgagaaaagccacctgcaggtgcttttgaacacaagctgccccagagacccaaaatactattgtctaacacaggggtcagcaaactttctctgttaagagccagatagtaaatatttttggctttgcaggccatatggtctctgttacaactactcaactctgctgctgtagcctgaaagtggtcaaagacaatatcttataaattaatatgtagggttatgttccaataaactttatttatggacactgaaactgaatttcttttca

SEQ ID NO: 74 - DNA, 518 bp, Artificial Sequence
  eHGT_393h
tgaggcatagacacacagtggaaaatcatttctcttttcagtaagttttgggtctgctttaaattgatcatttgtttcatcagctaatccccaaacagagggcacgtccgctctacttgcaaaattcttgtatgtaagttgaattctccctttatcaactcaggccaataagtactttattttgtttttgcttgttgttagggaaaaaaaaaaaaaacaaagataatcagctcatactacttgcgtagctgtctgcattttaattccagactatgaacgagcgtcagagtgcccttatgatattttgcacaaaaggctcagtgtttatgactctactcagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgt

SEQ ID NO: 75 - DNA, 511 bp, Artificial Sequence
  eHGT_394h
  misc_feature (19)..(19): n is a, c, g, or t
agttcagctctttaatttnccattggctctaaccaagacagaagactttacttaagcaattggtttgaaattagatggacaagctgaaacaatgggctctctgttctttcctctctgtgcccaccaactggcattcattatttaatctgtgacgtgtgttgccagggctgcggtaatgacaacggcacctattgtcttcacatcccttccctattctgtaacatctgtcatggctcctgtctatatttcattttattttgttttattttgcttcttttacttttacaaggttattcttaattactacaaattgctctgaaatctattctaaccctgcaaagtgtagcatcattttgtaacttggcaataacaataaactgaaggcgcgtgtgatagcacccttttaaattactgtaattttacataaaactgtataatttcaaacaaattttatctcaaggttaactagataacctctctttttaaatacctgatcagttcacagacgact

SEQ ID NO: 76 - DNA, 624 bp, Artificial Sequence
  eHGT_395h
ctggccttggtctctcctgggctagaacaggccccttgtctgcctccctgaatcactcttgaggctgggcatgcaccttcccccactccagatgtgctgacagcagaaatgccaacccctcccttgagggccagtgaattcagcagtgacaggtcactctctgagcgagactggttctcccttcatccgcttgtaaagggaaaaacagcctcggcctctgagcctggcaccaccaggtttggccagtcttggttgtttgcctaagtcccagtgccttcagttcccatccctcttctctgacccccaactcctgagccccttgcctgtcaccctcccccaccccagctgctgcatgtgccaaccccccacccaggagaaaacgaggctcttggaagggaataaatggaggctctgtgcaggcttgcagctgaaatggccctgtgcgcggccacagatgggcctcctctccccctccacatttctgcatcaacaaagcgtgaccttgtttggatgacagtcgccccatgttttccccatgacaatgcttgccttgcctttgcctcccagcgggctgtctcaggacatctctgttccctgaaattgggaaagggtggtggggtggaa

SEQ ID NO: 77 - DNA, 340 bp, Artificial Sequence
  eHGT_396h
gtctgctttcaggctgctcagcaaaacatccctagactcaccacccagaacagagtgtaaagtgggcttgcagatagatgaagggaaccattggtgaggcttgctctcctatctattgctcatattcctagatcttgagctcaggccctgtgaagaacaagcctgggctttgtgcattgtgcctgctgctgctgctgctgcagggacagctagtgggcatctcttccgccctctggctccgtcaagctccccgagaaaaggaaccattgactcttactgccttggaacctagtggtaccatccgagtggtagagaaagtgccaggcagggtgaatgtgga

SEQ ID NO: 78 - DNA, 424 bp, Artificial Sequence
  eHGT_397h
ggagatttggtcctgattttgaatggtttttcttggtgggcagtggttgtctgaggctttgaactgatctttaacacacaggaatgagttctaggcacttctggagtggtccagagcacctctaaatacgaagcagcagatgaggtcatggtaattcggggagtcagaagtggaagggtggggggttgaaagctataatcactgtcaaaggggtgttttctgtagacaagtgaatggagctattgtacacaaactcagtggttgccaagcatgtggcccaattattttgccttcatgagcatggcacggaaggatctctttagagaacttgattcacacaagtttgtgtttagtctaacggtagcaggcaaaagcctggggaatttgaacctaagagtctttacaagttcctgcctcccaaatc

SEQ ID NO: 79 - DNA, 500 bp, Artificial Sequence
  eHGT_398h
gctccggcctctctattcccactgctccatccaggaaaaccacgcccagcatggcaaagcaaacccttcctggggtccccctcactggggacacatctgggcaagccaaggacactcagaactcagcctggccaggctcggtccccacccccgctctggcccttctccctacagtgaaagggactttatggggacaaaaagccacccattgtatcacacgagacaaaggggcaggggacagaggctccgggcgcctaagctggccacgacacagccacacaccaccccctgactgtgtgagagggagggcaccttggaattcccatgccatgcattccagcattcgaggatcctggagtcatccccgctctccaggaaggcgacagcagactcggaacccagccccagatccactagacctgggcagtactgaatagccctaagctctcttttctcgtcggaaaaatgggcatgtaagttgccaaacggagtcattcagt

SEQ ID NO: 80 - DNA, 282 bp, Artificial Sequence
  eHGT_399h
tccctgtccgtgacatcacttgaaaagcccaacaaagctcgcactcgtttagatttcacatctagaatagtatctgtataacccacctcctgtagatacctgtgtgaagagaatccttagagttcagtcatactggaatcagtattctataatttaatatgtaaataaaagtatttatttaaactcattgcctgcataagacttaacagtacagtactatgctagtaagacttgttaataaataatcttccagctgcagatggagctgtctcttgcagtacc

SEQ ID NO: 81 - DNA, 418 bp, Artificial Sequence
  eHGT_400h
gtgcttatgttgattacttctttcagctgaatagggaataaggcctcaaaaggtttatatccagtatttgagtacttttgttattctctttaaaaagtcagtattaggcactactggttactaccagctgaagccttacacagctgtgtatttagcatttaatcatgctaagaattgctaattagaaaatcaaaccggacaaagcatacccagtggagttgatacaataccatttctgtttgagaaccataaataaataatctttacgcattagtgtttcattataagcatttgtgctgaatgtggcaatatttaacaaaatgttttaactcactagaaataatttcttgatattatcctttcacagaaatccgtaatctctttaaaatatagccagccttatcaaaattaagtttca

SEQ ID NO: 82 - DNA, 385 bp, Artificial Sequence
  eHGT_402h
ggcagctcagcagtgggttagctggggcctgcacacagtaggtgctcagtaagtgcttgctgagtgttactggtgttttgttcattctttctcttcatcctgccccaccctgccctggctgctctttgctcattgtatgatccttttcatgagagagtgttttgaagagcgcagacagaatcttaacaaatagcgcattgtcccagcgatccaaagcaggactgcagtgccggggtggcccaaggctgcggggaagaggctggagagagcaaggcctgccggacagtggcagatctctaaggaaattgtcccctgggggttgtggttcttcccatcagaatcaggccttttgttctcaggaatgaggtgggctaagagagagttg

SEQ ID NO: 83 - DNA, 405 bp, Artificial Sequence
  eHGT_404h
gaagacagacagctgaggtaggatacaaaagagctattgatggcttttgtctatgtcagacagaagcctaagggaagggtgactgctctcgcctggtgtcatggatgtcacatgatagaaagttttatgtttgtttctgacattaggcaaacaaaaaccttttgagggctgaattaggcttttgttttgagcctgcaagctgctactcattcctattgatgagtactgatctgatttcagccttttcatttttatggtgttaactgtgtggggaatgtgtgtagaaggccggacacaggaccaccgaccccatctcccttgagttcacatatcttttggaatttcctttttttttcttttctttttttgtttcgtttcaggaggggggctgtctcaggagcttcg

SEQ ID NO: 84 - DNA, 392 bp, Artificial Sequence
  eHGT_405h
ttggtgttgtcctctggcccagccctgcccaggaacaggagacagacggccacacagagccttgcctctgataactggggggtggagaggttgagaaacaacgcttcactcagcaacttcctgctccctccgaggaagaagaaaggggtgtctgtgctagagccactcccttgccagcagcccagcagaacagctgctgatcccctgcatccccacgtcccggcggaggccctgggaagtgggaacatcagctggagagaaaaggagaaagcagtacattgagtgttgcttaggccgcctgcttcgctttcttctctcgctctccccagagacaatctcgtggcctgtgtttccccgcaggcaggccccagcgccctcaagcccagatgtct

SEQ ID NO: 85 - DNA, 354 bp, Artificial Sequence
  eHGT_406h
acctggaccaaatctgctgattcagtgctctgggctctctccacttcatcaccctcattggcaagtagtcgactgggcgggttgttcaaagcgtgccctcctcagcttctagaccctcccattcatgccatgtccagatgacatctccctgaacacaatgctccctctcagacacatttggatggaattatgcctggcctgaatgggaaccttgtctgctttctaggtttctcccagacaggggtaatgtttctagagtccatttactaggagcagcatgatgggactggggatgtccctttaaaaattaaaagttaagtttctctttaagtgccaggattgagtggatttggg

SEQ ID NO: 86 - DNA, 264 bp, Artificial Sequence
  eHGT_407h
tactgctttgctccccagcccaggtgtcaccacccagtcaatcagaaagtcaaagagtctgagggcagtggagggaggttgtgcctggcccagagggttttaagtgtgaactggattgagaacaacatgccgattgttctttgtttgctgagactggcttggtgccagcgcagaactggctggccctgagaagcttacagagcctagtgaccaggtgtggggaaccagcactggctgcgggggtgggggtagaagggagcacag

SEQ ID NO: 87 - DNA, 604 bp, Artificial Sequence
  eHGT_408h
agcttttggtaagacactaaactgtctcgaagactagacaggaaggaaaaccttgaattactctcacataattccactccagatatctcaacagcaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagggtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacaccct

SEQ ID NO: 88 - DNA, 389 bp, Artificial Sequence
  eHGT_411h
gagacggggacttctagcccccagctggagcctggggctggggaaggaggaacctgaggttagggtgctggaggatgagacagctgcaggaagcccccctcccccatccacacgtcacacccaccgctccttgggcctgggcttaggagaaaaaaggggaaactggattctggtcacagggcagatgcccagtggcctgtgggggaagggaggagaggagatttggagcctggaggagggtcaggtcccagctcagcccacggtcaccactgttcaggcctggctgagtcccctcccttaaaaacccaagcctctcccattgtgtctagagcgagcatggagggaacagaccctgtaggtcctcccgggcacaccaggccacccaatgt

SEQ ID NO: 89 - DNA, 440 bp, Artificial Sequence
  eHGT_412h
gaaggcatagctggagggcacaggggctggggccactgtcggagcatccagagtgaagtgatacacaggaggacagggagtggctcggaggtgaggaggcctggccgctgaccatcccagccaagcgtgaggaaagatgcgtcagcgtttctggtgaggtcagcaatcagtgacgtccctctcaccagcaggaaaagcttgcaacatggcccagccagtataaataggctccccgaccacaggacccgggctgtcccctcttcccgggccacgtcagccaggcccgcgtgatttggagaggaagagaggaccagcttggttcctcagaactgctgcttcctcgctttccggcttaccctctgctgtggggccctacgcctttaaatgcaaggataggacctgagatggcctggcagggccaggtcgaaactggaggctgg

SEQ ID NO: 90 - DNA, 692 bp, Artificial Sequence
  eHGT_413h
ccaggctggtccttcctgtctcactgaggtctcagacctcatgctcattgggacttggctgaactccaggccgtcagcccaacagcgctaaagctacagccaagccgcagagagccgtggcctcccacgccccacgttgctgggcagagaagggaagcatttcagacaggcaggctggcccctggccagcaggtctccagatgccatgcaacacacacctgagcagggtaagagaataggtgtgtgtcaacagtatttgaaaaagaaaatagctgcacaaatacagcacttgttaacacaggtgtttacaggtggaattatttttccagggctgctatctcccagccttctttgtgcttctcagctcacacctgcagggactttcctacgaagccaaggcacaaaggggaagtggatagtccgtatcaattttaccacggaggaggtcagcgatcggcttcaggcctggctagttttcacagtttcccttgctggactcacttccatgttttcaacctgctctaacaggatctggcctgcgctccacttcctgcttggctaaggcagctgctgtgaccaccccaggcagtcacagcaagaagccatttcctggggccagggcacgctggctactctcgggacataattatctatctggtccttgtctcctctcccccaggagaggctcaatg

SEQ ID NO: 91 - DNA, 433 bp, Artificial Sequence
  eHGT_414h
gccatcactactgccaggcagcagccagcccaccagagcctggccctggtggcaaccagttagcctctgtgacctccccatctgactccatcttccccctctgctgtggaccttgtctaatttctacccacttcagagactaggacaaagatggcatctccaaggcattctcttctccaagctgaagacccctgtgtctgggaggggctgggaggtgaggtggggccttcctggaggatactaaaagggctcctaaccctggtgtctcttccctcccagcctgtccctcttatgccactcatggcatcaatccgtccagagggacactccgatgactcacccaccacagcactttcacttccttcttctccagaggaggcgtctgacctgctgcagctgcactgaagggcctcttctcaggggcttccaaggc

SEQ ID NO: 92 - DNA, 356 bp, Artificial Sequence
  eHGT_417h
gtgggatgcctccatgagctccaacaggcagcctcgccgacctcccagctctgctcagttgctcagcaccccatggagaaggtgaagcccataatgaacacactgccctggccacttacttcctccaaccaaagaagccctcatctcccgggcctagaccatttccggagaccagcttgtgacagagccacaacctccggtcactctgtcagctatctgcagttcctcctttttcctttcctctctcccctcataaacaatgactgttgatgtttccactagctacagatgctgatgccaagattagctttggtcaagatgatattctccatcctccaaaacaatgaccaaaatgt

SEQ ID NO: 93 - DNA, 433 bp, Artificial Sequence
  eHGT_418h
agcaacattctgtgtgaaaagccatgatgacaaatgaatgaggtatatcctagggttatcagtgaaaatcatcatagtttgcactgtcagcctgagtgtgcagaggtccacagcaggactgccccacacaggaagaagacacagagaggaatctcttactacttgcttgcctaatcatttccacttaacacacagtgaaagcagaacttcgtgacatgcttgccctgtctgggcaaaggttctgcttttttaggaagatcttggaaaaagaaaaaaaaaaacaaataacaaaaagtcccccaaaacttggccatgagtggggaagagcttctcaatctttcatttattccactagcatctgtagtcagtttcttcatcctcgtgccatgtatccacgtgcctggcactgtgctggggactgagacctgcgtac

SEQ ID NO: 94 - DNA, 560 bp, Artificial Sequence
  eHGT_419h
tcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggc

SEQ ID NO: 95 - DNA, 469 bp, Artificial Sequence
  eHGT_420h
agttgctgagcccagtctgggtggtgctcctcccaggctcccggaagccccactccataggtgcaggcttacagacttccctaacaactgctgcaggccacaacctcaaactcacagcaaacaggaagcaggaggtgctgtcacatgtaacacagtcagagcttcaagcccccggaaaagctcaatgccagatttcattctctgcccctgatgatgccccgcactttcttaactatgcagctcagaatctctctgtttctcacgcagagaccaaggacaccatctgccctacactcaccccaggaaagcattgttggtaacattcctgaaatttagtcatccaacctctgctagactatttctagaaggcagcaaacccagcaggccttcagggacaatgtggacagagtctgctccctctttcacatctcattttgtctcctcttctgcaagctaaactaccctggct

SEQ ID NO: 96 - DNA, 379 bp, Artificial Sequence
  eHGT_423h
ctgagctccaggaaggccacagctcttaggcgcatgacccacaccaggaggtttcagtctagacaggagctgggaagaacttaagcccctgggccaatcagcaggggaggaggcccagcctgtggttccaaacaccaggtcttactcagtgtccccaaccacaagccacaggtgagtcagcatgccacttcccgagctgggtcccactccacgccctcacttctgttcttagaaaaggacgaccaggcaatcttgtaaaacctttgcttcccattactcggcccacacagtcacctgtgtggcctctttagctacatgaatcttgctcaccaccttcagcttttcatgccagccagctgcctgccccttacacgttcct

SEQ ID NO: 97 - DNA, 419 bp, Artificial Sequence
  eHGT_424h
cagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgcccca

SEQ ID NO: 98 - DNA, 315 bp, Artificial Sequence
  eHGT_425h
gggccttgatcacctctgctgagtagctgactgcggggctggggctctgatgctcaggacccacctctctgggacccacagtctttttccactgtggcgtgtagtgatgtcacaggtggcagtgatgtcactgtggtttgaggtacttggctgtgagccccggaggaggaagtgtctgttcgctgatggggggttggaagagatcattgacttctgccccaagcgtgagccccaagtgtgcaggggggagtgcggggggagggctgttggcggcgcatcccagggctctggctctgcccttgcatctagcctgtc

SEQ ID NO: 99 - DNA, 443 bp, Artificial Sequence
  eHGT_426h
gctgacagcctagccaggtaagtcttgatggggaataagagggaagaaccctgaagccaccctggctgatgagtggccagaggaatgcaagctacaagacaaggtttgtaacctcaaaaagaactactgaggtcaacttctcctttctccaaagttggctgggcttttggctgcttcagaggaggtgactcaggggaactcccacccctggtgtgttctttagtttctcgaaacttatcatggctacttccctattccaaagccccgaccagagcaaattatctgtaggggagaacgatcttcaatagtgacacgagagtaacacaaaggggagcaggaaaatatgcacgagaagccacctgcatgccctccggtcgtcccccttggtcccatggggccaagccttggtggtcagaacacacaacgaaggaaagtcgcccaga

SEQ ID NO: 100 - DNA, 345 bp, Artificial Sequence
  eHGT_427h
cctccacccagaccagcagcccaagcccctagaggccccgagctgaggagccccagttggggcagcagtgaaggtccggatccttacctgaggctgcagggcggaggagagctcgccctgtgctccaggctccgaagtggggttcccttcagggagggcagggcttataaccccgaggccacgtgggccagatctcagggcgcccaacggtctcagagcgcgccccgcccccgcccgcaggggatgagcgccctccctccctccctccctggggaggacagactgacaggaaacagaagggggtgggcccgcgggagggctggggaccctctctcatgccctggg

SEQ ID NO: 101 - DNA, 232 bp, Artificial Sequence
  eHGT_428h
ccttgcatcttttagccgacccatatgacttactcattttgtttacttcttactacttctccaatttttattttgattctaatctggtcattgagaatgtgacttcctcttcttagttttcgtttcccagctaggtttcatttgctgtgtcagtgactgtttttttttttctggtagtattagtcattgataaaaaatgttctataagaagatcgagtccaggaccatacct

SEQ ID NO: 102 - DNA, 471 bp, Artificial Sequence
  eHGT_429h
agcagcagcagcaggacacagtcaaagggaagatgtgaaaacatggagcttgcagaagaaaagtcagaggacacctctgttaggcacagttttaactctccaaatggactgggtacttcttccaactgtctactccacaatcacatgagcagtagccgcccccactgagtgctagctcagcacacccgggtgtctgattgccagtgattcttatagtaacactgccaggtctacagtcacattaaaggaaaccaaagttctctgtcatgccacactacacacatcctgtaagtgttctgatgtctgtcctgtgatatcaacaaagaggaagcaatacttcagtggaagaaaacgctactcagtcatggcacataaagagaaccctctaataatgtctcagatgagatacacctgaaatggagcatgtccgagtccatctgactagcggggaacacaaagtacagatgcatc

SEQ ID NO: 103 - DNA, 297 bp, Artificial Sequence
  eHGT_430h
cacggtgggaggaaggaacatgttacatttcttcaaagataactgcagatcgaatgccttcatccttgtgacccgcgctgcctgcactgtggtgtgttttgcttggtttgcaccaatgccctggctggcggtcacttgctcttggtggccagtttcatttcctggttttgagaaaatgtcagggaggcctgttgcttgggcatactgtcactgagggaagtgtgcagttttaaaatgtcaaagccagcaggctcatgtccagtgcatgccatcaatcagcaaatgtccctggacccc

SEQ ID NO: 104 - DNA, 786 bp, Artificial Sequence
  eHGT_267h
aggaagcataaagctccactgtgccgaagttgtgcagggtacacgtctctctgttcccagccccgaggcctggatagtatgagaggatccagccaccctaccccagtgcagccctagccccagcagagccaccacccagacctgcagccccgggctggactgggggtggggcagccctgagctgggcccatgctgttcacaggaaccagctgtctgctgttcgactggagtcctgtctctcacagagtccccggtcaagcctgggtgccctctactgcccgtgagccacacagcaggtccgggggcttcctgccgcccctcctgagcatgcaaccccacaggcgtgcccgcctgggcagctgcttcagggtctgggggcagcccgaggcgacgcccaagcaatagcggcccagcgccttccagaagtctccagacactgaggcctctccttgcaggcctggtcgcagctttattgcccccactctatggatgactgcatgggtgagcccacggccatgcagggagcccggtcctccgggctgggaccggccttgagatgggatgcatggccaggaggcgggcgatggccgaggtgaggggctcagggagggggctggtcatggcattcagagccaggttatgatggggcctggccattgacgacagacggggtgatgacagcggggccccaggatggagcctgcagtccacgacattcagagcagagcatggggcatgcaggaaagggggccagaggacctgctgggtctttccgggtgtatggtg

SEQ ID NO: 105 - DNA, 308 bp, Artificial Sequence
  eHGT_268h
aaataaattacctaacctcaacttttctttttacagtgaggaatctgaggcccagagagattaagaagcttcacaagtgacatgacttgtgccaaatcacaaggtcatttagttgcagaactgggacaggaattcatgcccagttctcttttcaaaaccctgtggaaaaaagaagcacattgaatttagcctttgattcgtcatcagcattatcagaggtaaagcaaaagggagtattaacagatgttcagcaaaatggaggaggtaaattcagagcagatgttttgacaatgaagtaaagaaggaga

SEQ ID NO: 106 - DNA, 332 bp, Artificial Sequence
  eHGT_269h
tgccaaatggcactgacaatcctaagatatttaaatttgcagtttaatcaatctgctcattgtataattgtagcctgcagtgttcagtatctgaggcaacagataggactacttcaaggttggaagactgaagaagggaaaaataaaaggtcagtttagaatgggactgttctccagttagtctccttacaatattcagggaaatgtaacattttcttggcccaattatatgcttgtttgtttggagacagggtcttgccttgttgcccaggctgccatacaagtggcacaggacagctcactgcagccttgaactcctgggctccagtaat

SEQ ID NO: 107 - DNA, 505 bp, Artificial Sequence
  eHGT_270h
ggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttca

SEQ ID NO: 108 - DNA, 380 bp, Artificial Sequence
  eHGT_271h
aaggaatcttctagaccacaggccccacctttggggaggagggggtctgcagagctgggtgttgccctggctcagtgcctggcagaatagaagccacagaggcagctgggccctgtcctgccccaggagaaatctcccagggtgacccacagccctgcccacccctctgtgaggcaggcaggaagtgaaagaggaaggatccctgcgaaaggacccaaactgttttctgccatggggaggtcgggggggggatgccacgtctggcatctgtgggcggaggctgagcaggactcctctgcaggggtgtgtggggcaggcaggatggatggcagtgggcacttctcccactagaagtggatcccatagatgacacttcaaga

SEQ ID NO: 109 - DNA, 514 bp, Artificial Sequence
  eHGT_272h
tgcaaatgtgtagttttcttaacaatattggccaatattattttaaagaacatctctgaatgttttcacgtaagaaaagagactgtcccagaaatcctggacccagttatcctgaagtttcctctgattcatcaagtatttaagtttccaggccaacagaagcctgaggctcaaatatttgtagcaaatcggtgactcagggcaacacagcagaaccctgagaaacaatgaagaaggaattgtttataatcttgtgctcagttacacaaaagatacacatttattttcaccaccacccaccaaagaccccagaggatccagaggctataataatagaatatgttaccaaaggaaatacaagatgacccattaaatttgaatttcagatactcaaacaaaaaaatttaaagtatgctacaggcactatttggagtatacttatactaaaaaaaatgttgtttatctgaaattcaaatttaaatgggcaatttttatttttgtttttgttttgtta

SEQ ID NO: 110 - DNA, 587 bp, Artificial Sequence
  eHGT_273h
tatctagaaacagagattgagagcagagacaaatccacaagacgtaagaagaaaaaagtgatgggcttgatgattgaggaagaaaaaggactggaatgaagtcttgggattccaatggtcactggaaggggtcggcaagcttcttccattaattcattgcctttaattatttgatcataggaaaggagagtctggccttgtggaaaaacacacaatcagtttcattagaaaagagagagtcagatgtttttaaaacagcaacaacaatatgccctgaatagtagagaaacaaaagagcgattgatctacaaaggcaagacccagattgagaccacagtgaaccctgcaaaacagaggagcccctgggtgggaggggatataactggaactctgggaatgtaacgggcatggtgtgcttgtctgatggacagggcagcttaggggaataagtctctgcagcgttgtagtgaagagagaatacgggacaactgcaggaccacagctcagccaagagtaagcataaatttaaacatatttcttgatttctctaaagtctctcttttctgttaaatacaaataataatgca

SEQ ID NO: 111 - DNA, 615 bp, Artificial Sequence
  eHGT_274h
atcttgtagggaatttgcttgaaaataaattttaccccctttcagagacttagtgtcctaaatgagctgatggggaacctggccttgtgatccttttttccactgaagcaaaaaagaagattgtataaaaaagaaatggctgcaggatccaggattttgcctttctttgtttcctggaagacttcaatatatccgctaattagaggttgcagtgagcagatattgcaccactgcactccagcctgggcaacagaatgagaccctgtctcagaaaaaaaaagacatccactaattaatgcaaagttagtaattaactggctccctttccctagaacatggtccaggtactgtgttcacttaaagactatcagagttaccaaaactgttagctggaatgatacaggcatggttaaaatcctttggttacatttatactgtttctagggaacctggcatagtgctgaactacttgcactatgggtgatttcacccagtcctttgatattgttggcagaaagaaaaattaatttgggtttgaagtgtgaaggtcccaagcatctggttgttcttaatcaaatgtgtaaatttccagttggaagttagtcatatttcagt

SEQ ID NO: 112 - DNA, 483 bp, Artificial Sequence
  eHGT_275h
ggaataaaaagaacagagatgggcggtgggatggagaagaggaagcaacagagaaagtgtttttttagagccagttacaagtaataaggctagtgtcagcttcacactaacttgtttactggcctccactgatagtgagaagagccacaatagagctgaacaaatagggagaataaacaagcttgaaacatgccctacttgggaggcagcttaattacacaaactgaagttctgaagcaaatagaggatcctccaagactccaggggctctgctctgccaagagaaagaaagcaccttatccctgggcagagaatttcattccagaggagggggaggggctgctgttggtggcttttgcagtgggtggagatagagtagagaaggcttgcaggggtgggctggcagaggggaagggccaacaatgaagttacagatggatgagtgggtttctgccacaaaatcagatcaaggagagggaggtg

SEQ ID NO: 113 - DNA, 519 bp, Artificial Sequence
  eHGT_276h
gaaaagacccacacgccacaagcagatgatgattccatcacagaaggagaggaggaggcctggaggaaggcttgtctcatcctagcaaccagaggttttctctcctggtgtggcccaggaaagtgagaagacgtttccttccagctatagtcatggagccacaaagtcgggattcaaggcaaattaggctgctgatttgtatgttaaacaaggttaattccatccattagccaaagatgttttcaaagcgcctggcacaagagcgaggagcaattagtgtctttgtattagtggatgtgggcgtggggccaggacgttaaggggagggggatgcaatttctgcactctttatgatatcatcaaaagtaaatgaattatgaaaacaaaagaggcaatatgaggcttccagtactaattactgggtaggacagaaagttcacagtgaaggaggaaagaatgatcagagaaggacaaggatacggatcatctggcctgcaggtgtctttagacaaggtgggg

SEQ ID NO: 114 - DNA, 490 bp, Artificial Sequence
  eHGT_315h
aggagcgaacatggtatgcataattgaaacactcctccttgtttgaaatgttgtctcctcctctgcagtcctgcggcaaagacaggcacacaggctttctctgtggattaattggtcaggaaagacactttttatattgtcaagtggcacttaagccattaattcttgactgtgaaactgcttttcctgggcaatgctctttaaggaaaaacttattcagtccagtgactggtgactaagggaacgatggagcacagggaattgggcgggatctagactcctaataatgcctccttagccaatgaaaagcatttcctattgagacccccaagagttcccctggccgtcggctccagctcggacttcaggcctttttgtgtcctgtttgctaaaggcatgcgggctacagcattcaagagagggagtcgttaacaaagggaaagagataaatgtaaataagctcacatttacagaatgagcggtttgcagt

SEQ ID NO: 115 - DNA, 563 bp, Artificial Sequence
  eHGT_316h
ccattcttttgaagttggcactttgatttctagatggttccccaacacaggttcttctcctcctcatcattatagctgccttgaaatttgagctggaagggaacattctgagacccagattgttaaatgtcttttccaaagtcatgcaataaattaaatggcaaagccagggcagtttcttgactcagtacagggtattttctttcattctttactcttgagactttagaactgttggtactgctttaaaattcatggcaagaactggtcacttttgtaattaacacctccttataatacatttgttttgtttgcttagccagctagaaactacatggagtctgtgctttaaaaagcctgccgaagtccttattctctgttttggtattatgtgcatgaaccaccaattggttccttctcaccttacacttgatgaagatgtctttctttcaacatctttctctattgctccccatcttctcttgctctatttatgatcagctgtctgtttctaaatagactttgtggtcacccatttctttttgtgccagctcctatccact

SEQ ID NO: 116 - DNA, 748 bp, Artificial Sequence
  eHGT_357h
aggttgtggccactgtgactcatatacatgtacatgaacgtatctgaagttttcagggctgatactgatgtgaggcaacccatgcaggcaacccggaggaactgtgtccctcactctgagacagtgagaacggactgagccggaaagctgatggccgtgagaggagcaggtttgaaaatcactgaatgaagtcatgttgtacagagggggcgggggtgcatactgtgggacggaggtgagtcacagtgcataagtgttggggagtcaccttgaacttgggccagaagagtagaaatattgagacttgggtttatctgcctcacatcaggtacatcaagttctggatggctgcccactggccagagacatgaggtggacggctcccttttgctgccctgggaaggccttctgctggcttcggccccactgagcaaagtctgcttgttcactggagttcacacagactccttgccaggcctgcccagaatcctgtctcctctgacttcctgtgctcttgcataatatttccttgctccctgaatggctggccccagtgcaggagcagctcactcacactgctggaccgagggcaggatgtagagggagggcagggatctgcaaacgtcacccaggggtgctctgggctctgagggtggagggcaagaggggcagagccccctcaaattctttggaagattatagcacaaggggagttgggaaggccctgggaccatgtgcacacacatct

SEQ ID NO: 117 - DNA, 469 bp, Artificial Sequence
  eHGT_495m
tgtagactgaggccccgtgtccagaataattgtgcacttccacacactcgcagtccagcactggagtctcagctgcttggctcagagctagtgatacatccctgaccccagagaccccctgtgagccggggtttcctcgggagctgctgtatgagctttcaccaggctgagtgtgtagagtaatggggtctccagaggaagggggtgcctcacaggagggatgggtaactccggagttttggatgcccccagctccagcatacccagctccttccaaggccacccagcccccgctggcttcaaacttcactggcttttggcaaatcctgttccgccaggtcctgagaacggctgccggtcggagcaaactcaaaggccctttacaaaacccaacagcccacccaggccttgggcccctcgtctgtgatatggagggcaggtcctcttcgacttccccaaccccagagct

SEQ ID NO: 118 - DNA, 463 bp, Artificial Sequence
  eHGT_497m
ttaaaaggccagggtgggaccagactgcccagataagaggcagagacacttggaagcaaggcttgaatgagtagtcagctagtatttatgtagtgctaggcatgttgggggaaaacagaaaaattataagacgccatgcagtccgtggcggagcttctggtgagagtcccttgtgtaagaatcaggactggtgcctggttctgcccagccgatggaagcctgccatggtttttgagactggctggctagcctctgtgtagagccacagggagtagtgggcaagccaagggtctaggaatgaatgagttgagtctgtgccacgtactaccaatgagtcccattccctctaaagctgagtttccatagctgtgcaatgtgaaccgcatcaagacttgccaagcccgagcatacctcagcagtttatgggaagtggaataagcctaacaaatgtgggttctgagct

SEQ ID NO: 119 - DNA, 1174 bp, Artificial Sequence
  mscRE1001
tctacaagtgtctcttcgaaccaaaggacatgcctgctaaagcatattttataatctcttaagagctggagtaagccttagtgtggcaggtctgcgtgtcaaataaagggtttgagatgacagaacagcagcgtcctctcagaaggtccagctgagcccccagggtgagggggtgacatgctgtgcacagtggccctcatttgagcaggaatgccgttcaggtgcctgctgtgcctccctggtgccaggcccagctggctctctaccattccagccctcctttgccacatcagtttgttcttaattccttctcggaaactctgctcctttgccgcacaccacgtgttcagccaggccccatctgacagctggggcccctggcgcaaccccacagacacccagtgtccctttcacaggctccggtgagccaagtctacttcctttacaacccttttataggccctcccattctggagccttgtgtgccatgccaatggcttacacacttgatgaaaggactcaggggctgagaacttggatcaatgaggtctttatttttgaacatcagtaaacagcacaaatcagttgaatgggtgcagccctgttcgtaattccaatgcttgctgtggtttccagccagcattagacacacagagaaagtgctcgttaatgctagctaatgaagaatgtggccctttttccctaacttgaacacactccaagacgctggcctgaaagatcagtgtgacactggagagggtgaatgggaaaatctttaaccttccttttgaaacagcccattgacgtggctctaaccactttctttcctcttctttttggtctgctctctggcattgcgggatcagcttgacgcaaaatacaatcttttttaagacccagaaaatcgtgccaggaccgtttcactaactgaactacaaatcgtgtaattagagatgaaaagtcccaggaaccttcaacttgtgcctgtgcctttgtcaaagtggacccctgtcactgtgttttgggggttgttcttgtcactcttgctgtttatttgtgaaaccactcacagctcattcagtgccaccagcaagggacatggcctccttgtttcaactaaaaatagtcattggtgtggttaaaaccacaggaaagtaatctttaaaaagattta

SEQ ID NO: 120 - DNA, 1143 bp, Artificial Sequence
  mscRE1002
cacttgcaggtttcttcttccagtcccagccctctggcccacaccccactgctgaccacaggagcctctcacagtgctcactcagggcttcaaaactctctccctggcagcttctttctattctgaagtctcccagtccagcacaaattagtcccctctcctggactcctactgcgccgccttggtacatcacagagcactggctgagaaaatcgccctttagtccccgcaaatcactctcttacctgctccactgactaggcctgtgccattatttattagggaatgagcgctagctgttgagggtcaattattccattgaccaggcattacaataattcctggtaattaaaagaggtacttatgtgaatctggatgcgtattgaaagaaacattagtccttttgtcagcttggcaagtctattgttctgagccaggcccaaccaattaacatcttttgccaatccctgtcagcaggggcttgcaaggaggagagaaaggggggccggtcagatgctaatttagatacaattgtgtcagggtgcatgggaggggtaactctgaagaagagactccagtttaatgaagcaaacagcttgggtcccagtgaccctgcaggggtaattttaaaaggcccctctgtgttcctgtgccaaattgcagagggccagcaacaagaagcccttcaaaaaaaaaaaaagagggagcaggataatcatccacttaatctgctcattaaacaaatctctcaggcggacttaacgtgaattagcacttctctgaaaggggcagccttgatgagcagcagacagctcagatcatttggaaggtcacagttttttttttattattatataagcccagttgttattaatgtattcatatttgaagaaactgagcagagacctgctttcattcaatctagtgagcaaaacagtacgttttcctaactggaaaacaaaacataaatgctaatcaggtcccagcagagatcaaatcaagctaaatatagcaggcaccctttgtggttttttttgttttgttttgttttgttttttgtttttttttaatacagaaattaaggaaagaaaaaaaaccattgaattaattgtcttcctctgtgcttcgcacctgacaccagcg

SEQ ID NO: 121 - DNA, 1386 bp, Artificial Sequence
  mscRE1003
gactcctttcccgtttccatcaaacctcccccctgcacacatgcaagaccagttttatttttgttgagctacacattcggttccctcttctctccggtctcattaactccactccgtcagattcccccgcttttctaatgattaaagtcgtgggctttttaaaaaggcctccaattagcacctcatcagctccaattagagcagacaaaggccgtgtaaagataactcagtgagaggggcgggagcaacatcatgtaatcacttaagacaggctttgagaattctcccagcgacccacactgggcctattcacctttctttcttccttttggatgcatttaagactgtttggctgggaagacaggccccccaggagtctcataattcctcattcacaggctacctgtttacttctgggagagtccaaggacctaaacaatcccatattgtacgcctgcttccttaaattccagatccctaatcgtgtgtttttggtggccctcagaacaagttaaaggccagctttatactcccagagggttctccttgtactgtcttctaattacaggagagagtaacaatgtattttttttttcaatgagagttctttggagcagttaatttggtgcctgtactaaatgcccccaaacattaattagggtggaagaaaccctaattccctcagcagcgttgccctccatttagttccctcgtttttcacataggcctggacgagtctccataatgaaattacctcattaatgcctttattcttcacagtaactcattcaaaaccgaccatttagctttaattgaatgctgtcaaaaggaaagaggtgcattcatggctttgattagcaaaaaattttcccccctgaggggcagacagatttaaattatgaagatggtgagtagtgagttataattgggtacaagcagcactttaggagagctgaaacgttttcaaagccggggttggccagtctgcggactattaactacgtccagggccttgttctctgtttgaattgatggcaacttaactatccaaaagaaaatggggtttactttttgtttaatacacagtggggttctatttacccacagagcgatcgtttcttcatgagctctatctttgttcccctgataatttattatttgtgctttctaacacgggtgctggagggcgccagcgccgtgcatggtgcagtttccggggagagttagaatagagagtgcacatattgagcaactgggctgctggcccagcgcctccctggggcagacacagcgaggtgaagccccgagtcaggagcaagtgggtgcagtggaaccttgggaactcagccctcagaaagtctgctctgacttgatgcaacaatgctg

SEQ ID NO: 122 - DNA, 1661 bp, Artificial Sequence
  mscRE1004
tattttataggcatagactttgccatgtaagccaagctaagtatccctggaccttcaagtgatctgcctgcctctgcctcctccaccatcatgaagctcaccattgtcacagcagttttttacctggatgctggggaatctgaactcaggttgtcacatttgcaaggctggtactttaccaactgaactacctctttggccctactttttttgttttcttgagaatgttctagaaagctctctgttaggtaatattttttttcatttgaagttcaatcttccctttctgtttctaagactctcagagaaaattaaacatttattcttctattaagcttggacaagtactaagattaaaaaaaaaaaaagcaaaattagcattgctttttcaaggcaaaagcaaagacagttcctttatttaataaccttcactcatacaagaaccaagctcattagtcaagtattggccacagaaaatgaaactcttaagtctccatgaaataatgtctttggtcctatttagccgagtgaaggatttagacacaaagcaaacagaaacttgaaatctggtcttctcttctctccagaatatttggtctaaagtaggtcagaccctgctgcaactaatcttaacacttcttttgattctttcactggctctacttagaggagcttagagaggggaaaattcatccaattagttaaagaaaaactgcaaatgagagaaaaggcctcctgaattgtggtgcggggtctctgtctccagcgccaatgagttcatcaacttgaaaatgattttcaaaagaatagctgtctatgaggtaatcattaatcccccggatgctttagtggctgccctggctgccctcaaccatccattctctctcctggagtctaagaaggatgctgacacagctctggatgaagccaagaccatgcctcaagagaagaagagaaacctagaatgaccctcagtccttcaagacagccatcgcttcccaaaaaaaggcccagcaaggggtttcaaaactctagagttcagaagaaagttgccaggaggggcctggattttgaaggtgtgtagaggaagggagtccactgaaggtgttcatagtctacattggtgtgtgcacatagcgtctaaatccaagccgttgcttttccttggcctctcccatggattcccacccgaaccacagagtgggacccttgtttccaagagtactttcgccaaaaaagtgcacagcttttcaccacttacgtgaaatgctgccagctaaatatccttctgaatgatgtctttgagacttcccaggcacttaagctcctttctaaaccatcacaggccaacaaagtctgtgaggttttaagggatttttgctggtcccgtggcttattctttgaccacatcaaaatccaagggattgctccagaaactgtggatacagtttcttttcttgttgctatgaccaaagcaactaaagaaggatttgtgtagctcactgtttgagggtgtgatccatcgcaaagagggaaggcgtggggacaggttcatgagacagctattcacactgtatgagaggccctgaagcaggggagaaatgctggtatgctggtgctcacttttctttctttctttctttctttctttcttttttttt

SEQ ID NO: 123 - DNA, 994 bp, Artificial Sequence
  mscRE1005
tgcctgtgagtatgtctgtggggtactctcttaattaagttaattgatgtgagaagacccaggccagtatagggagcaccattccctaggcagggggcgggttatgaaacaaatgagtaggggaaattgagctgagcacaagtagcctgcatacatgcagttagttctctctgttcttgtctgtggatgtgatgcgaccagctgcctcaagctctcacccttgtaggttccctacactgatagactgtaacctggaattgtgagctaaatgcagccattttcctttcaaattgttttttagccagagtaattttacgacagccatagaaaccaaactagggcaggcccctaaacacagcatttttaacaagagcccaggcactgctctttctgctgagccttggttttggaaagaaaggtcaagagccttttatgaatgcaggatgcacctctcttatgcttcctccccttgccccgtctccaaggcatccattgagtgcctgtgtgcatgaggctgggctccaacttgtagcaaagaaacaagacacttggcattcaaaggggactcggtgtggacccaaccttggagctctcccttcttcttttattttttggctaagagcaaaatgaaccacagcatccagttcctggggcgcacaaccatggccttacttttcagggaaacaaacccccaaacacttggagagaagctggctttagggctgtgcctgtggctgtaaatcgcctttgaacattgtggaacatcttgggcctttccttcagaagtctttcgaaattgttgacgtccctgctgtctgtaaagagacaaactgctctttcatctgagctcacttggcattgggacatggcctgtctgtccccttggcttgttgtttctaacctcttcctttctatcctgtcttagtctggagccctgtcgctctgcattcaatggtgggcattgtcacacgagtgaatctcacttagcccaaga

SEQ ID NO: 124 - DNA, 1117 bp, Artificial Sequence
  mscRE1006
gactcattcatttctctcttatcttcaatgttagggactgattcaaaacagcataatcaaaacaaagcagagcacagcataattaaaatcatgtcttctgaataggtaattacaaaactaattggatattggtaattattttctttttacctgttcctggctcctttctcagttaatatgtagtgctatgtacagatgaagttcagatgcaattatgtacagggtctatctcaccaccaggaagcaggacttttctgtgtgatcttccatttcctgcaaggactacagaattgaggtacaagtgccttttgttttcctcaagttgagtccttctgttttctttgtcactggctttcatcctctgtcccactggctgtggctcagtgtttatttattggctgtttagtatggagaaacatccagtctttcaacattgacaacaaatccaaataatgagcctgcccatcacgctacactgggtatcatctttgcctgttaggctcttggctggttttttgctgtatttgactatcctcaaagtttgggagttctgactgcgggttgttattttccaattcttattaacacttgccaaatcttttgtcatgcatctttatactcatgacagcttctaggtcaaattttagttttgatcactggatctttagaaggaaagctaaggaactgacagacatagccagctcctttttttatgctggcaatggatactgattagctgtgtgctagttgttgaagtcatagcaacaagtcctacttactatcttttaggcatctcaattaagtttctttggtctttggaaatataactacaattaagtttcatctcctggagaaaatgagtatgttcaggagaacaacttcatagagttaattaagaactcttttctagagttcatttttaaactggtaagttatttgtactccttcattttccttttgtttccaggttttataataggcttttgatggatttaatcttttaatttcaaactgactatttgccaagattctggatgcctttgctgaggctaccaagttaagtatatgcatcagcaaccagaggaaaaacactaacgttgggcagagaagcaatgaa

SEQ ID NO: 125 - DNA, 1490 bp, Artificial Sequence
  mscRE1007
gagcaaagtatttcctgacaccgagccaaaataatgaagaaaataaagttggcccataataacatcggggctacaggaaagacactcaacaaaaacaagtcaccccctggtactcctcaaactttgttttaatttcccacagtggcacagaaagtctcctggccacaagttacctatcatcttaatttctgcttcttagagggtttgtgtttggtttttgtccttaatgagacatatttgccaaagaggctttcaaaaggcattttttgctcttgcggaagagtaattaggtcggtacctctttccctgccagcatcagctgcctaaagagaatcctgcctagtatttaatgcccaaacagaagaagcatcatttccactaattggtcctgaagttccgatgttcccaaagggtctttttattttgcaaggatcagaaaggacacacgtaaaatgtgatagcgtcaccagtgaccttcatcgctctcatctgcactattaccgtcatcctttcttatatttttttccccccagtggacgggaacacaatgccaactgagggagtgaggaaggcttttgcaagtttactgctgatggcatctctgggccaagttcaaaggtcacagcagaaatgcttataaatgagagaaaaagcacaaatgcataaaatatacaagagtttgatttctttgatgggtccattttagggacagtgttaagtactcgggggaaaacgttactgttggaagatgaggatgcagacgcaagggaaatacgggacgattcatcaagtgaactggaaatatagtatatactgctaactgtttttgtttttgtttctgtttttgtttttgtttttcctttccacagcctaagaggagttttggagtatcatatcacgcactcttatgacgagaagggaaacagatgataggaatgggggatgggcatgtagcagaatatttacacaaacttctcgtcattgaaagctctggaaatggccttattaactctcaggaagtttccaattctttaacgtaatgatcaggctacacggatgcccttagaaacatggccaagcaatcattaggcagagcttcagccatccccattcagatgggccaaagaaaccagactggaagaacagactgcctgctctgtcttctgggttaagttcccttttttttgcttattcttctttttttgacttgtaccttgaaaatgaagctcaaagccctatcatttcactatgttttatccaagtgacaggcaggctctggctgtggccttcttctctctttaaagagccacttttcactgcagaagcccagtgtcaaaaggcttgaggtgaataaagaggaggagagtgttaaagagaccctttcaaaaccaaaattgtatgttcccatgagcatggttttctgtgccactgaaagattggctatgcagaaacgagcctgcttgccagtgtctatactgtctgcttacttt

SEQ ID NO: 126 - DNA, 785 bp, Artificial Sequence
  mscRE1008
atgcaggcaccctggctgattcagacactggacaggaagcactactgcctgccgtttcttgggaagcgacttccagtctccaaacattttcctctgctgtgcaatgggcatccacacacttagcctcctgtcctgccccgtagggttgagcatcctcagacttggaccctgtgggatctgcagccaggtgcagaggctgtgcacacctgtaacttcagtacttggggtgtggagacaagaggagcaggagctgaaggtcatccttggctaaacagagttcaaagtcatcctaagctatgtgagacactcatacaggaatacattcttaaaaggaacttttgttagccccacctgcaggaagtaagtttgtgccaaagccctgggccccttacctatgcaagttcctgttaggttacaccatcccccactgagatctaagccttggaaaccccaggaaacaactgaatgtccagtcctttgtgcccttcctgatgagagagcctctctccccacctactgacacttagcaaaggctccatcacggccccacctctggttaaaggaggaagctgggtctgggtcggaaagtcccgcccaggtgtgaagcaagcccttcctctgcccacacccttcaccatgcccagaagataaagtacacaggatgagggccagctcatacacagccctgcagtcctgtgcggcacgtccagcatgttgtttgcctgtgctctccttgccctcctgggtctggcaacctcctgcagtttcatcgtgccccgcagtga

SEQ ID NO: 127 - DNA, 566 bp, Artificial Sequence
  mscRE1009
gtgctgcagcttctgttcacagatagaaaccatcattttgttgtccacggtctctgaagagcaactgacagaggaggctggtggtacttgaggagagcagcctgtggctccgccttttccttcctggagcactgctagctctttcctgaagcctctgcctggcccacagagcagacgtcacaagccagcttcgctagtgagttattacagacaggaaaacatctagagactgatcagacccaaggaacaggctgagtcatacagcaaggatgcgacttttctgagaatgccaagactcacaggatgtctggtgttttatagataacaattgttagagaacacaattatggcaggatgaagtcagtggggagagctacagtgtctcacagcagtacttcagattctgcatctgtagatagagcatcaagcagtgtgtacctgtcggtgtctgtcttgcttaaaatacagcctaagactgacagaagcaccttgagaggatgaaacaaccactcataaacagagaagtctgaaacacttatcacttcccctgaacatcagtgtctcag

SEQ ID NO: 128 - DNA, 431 bp, Artificial Sequence
  mscRE1010
aagtgctgcagcttctgttcacagatagaaaccagaactttgttgtccagggcctctgaagagcaactgacagaggaggctagtggtgcatgaggagagcagcctgtggctccaccttttccttcctggagcactgctagttctttcctgaagcctcggcctggcccacagagcagacgtcacaagccagcttcacaactacagacaggaaaacatctagagactgaccagacgcaaggactaggctgagtcatacaggaagcatgagacttctctgacaatgccaagactcacaggatgtctggttctctagagttaacaattgttagagaacacaattatggcaagatgaagtcagtggggagagctacagtgtctcacagtcctacatcagattctgcatctgtagagagagcatcaagcagtgcgta

SEQ ID NO: 129 - DNA, 380 bp, Artificial Sequence
  mscRE1011
agtcttagtttgtctcaggagacagaaagagatgaagcacagaagtccagtggttagggctgatgctgttcctgaaacccaacagggagggggaggaagggagaagggtcagctgtgttaggggcctccagacaagctggccagaacaatgaagaacaaagcctgcacgcttttccgctgaagctcagagcctggccttggccttctgtgaacagctctaggaaatggctgagattccagatttggaaggaagagactggtaaacaggagctgggctctgaggagaaggcagtctctctgggtttcagggaggagccaatacagtcagcttagttgttgtgtaggttgtgtgctatgtagccatagaagacaggtgtcag

SEQ ID NO: 130 - DNA, 521 bp, Artificial Sequence
  mscRE1012
agcagcaaagaggatccccaccagaccatactctggaagctgccctgggccagccaaggccagctgggcccggggtcagttgctgtgggtctgagtgttcagcctgtccagctcagtgcacctcggtgctggggaggaagaggaaatgatggttagggtaggaggggtggcagggagagagggtgggaagagttgtcgcctgtagtcctcccgtgtccagcccccacaagcccgggatgggtgtggcctggaagtctctggaagggggggcattagaggtgggaggcaggttgtgacaaggacagatctggggatggttgggctctctctcccatcccttcggtcccttccatctgcattgctggagcacgggagacaggaaagggaggaagccagtggcttccgcctattgagaaggtttggaggcaggacattgttctggggtctcccctcctcccagcacacacacgctgggaggaggggagacacacacacacacacacacacaaatacaaaatgag

SEQ ID NO: 131 - DNA, 551 bp, Artificial Sequence
  mscRE1013
catctggttggcctggacctagagcatgctggccctgccacatggggtgattgactaggtgtgagcaggcccaatggagaagggcactgcattccctccccttgtcaggcttgttcaaggaacatggagagatacgccatttccaagcccaccagcaacattccagtctctctacaccttttctgataagttatgggcagccttttcagtgatggccacccaggtaggtgtaatggggacatggatggtttgattatgatggcgggcatctttttatgttcatatttatcatttttataactctccagagaaatgcctagacgctagctggaaacttttcaggaaatggaagtgcgtatgactgggaggagttccttttgggtcacaaacatccagaggaaacagaggagagcaacacctggcagggaggaggtgggaggggcatcactgggaaggggaaagaggaggagactgctgagatcactgaagaggggaagccaggcagtggtggtgcacgcctttaatcccagcacttgggaggcagaggcaga

SEQ ID NO: 132 - DNA, 379 bp, Artificial Sequence
  mscRE1014
tcagtgtgaggatttcatttaagaaaccctaactcagacatgaagtaaacccttagcctgcagttagcatcccggggattacagctgaagtgtagaggtcagagagtttctcacctctggtcccctcccagttctctaaggcatgagggccaggcaggaagcatccgtttcctcaaagctgcttccctactgggacagagtctcagtcacaaacaactaccaccaccccacccctccctttcttcccttactgctgtgagctcagaacaaccggacaaaagtgtatgggacaaggagaggagccgagagcagccatgggctctggaggaacgggcctcctggggacggagtggcctctgcctctgctgctgcttttcat

SEQ ID NO: 133 - DNA, 529 bp, Artificial Sequence
  mscRE1015
atgccatgtgctgaaacccctgggagctggcttacctgggctgtagaacaggataagaagagacaggctccagcaagcaaaagaagacatctcaggtggggtctgtggggtctgtggagtctatgggcttcaggggcacagctgacggctgcctggagggttagggagagatgtctgctacaggtcggggagtgaagcctggcgctcccaactgaaatccacaatctcctctgtgccagtgagctcatttcctctaattatctgagatcaggaaacaatatgcacagaccagctcccaagcctttagggcctcaagaattcatgcagaggaagccaggaagcagcagataagcaggggtgtaacagggttctctcacgttgcatgctccctgtgcggggataggaaagcaatgggaaatcacatgcaggaagtgtgtgtgcatgcatgaatgtgtgcaagcttgcatgcacttacgtgttttgtgtgtgggtggggggagtgtacatggaatttctttaactgtacatt

SEQ ID NO: 134 - DNA, 566 bp, Artificial Sequence
  mscRE1016
gacgctgagcagcggctgcctcacctgccgggcgctccgcagctacccaatcagctggggtcgcccggcagcggctgccatgttctccgcttcgcgctgccaatcattgtgtcggtggccaatgggcgacagggccgggggtcaggtgatctcaggccagctggctccccattggtgcgcgctgcccagcctcccgctcggtttatgtgcgaggagtgagtgattgactttatcagtccaaggacattactctggaggtgaagaggcttggactcgcgaagcgagcagtgaggttcgagcctgcttactgcaggctgcctgccctctggccacgttccgcctctgcttcttggtgcagttgctcctgaaagccgggacccgaggagcctctggccccgtggttccgcgctcttgagtagaggaggggtgtccgggacaggattgacaaaccccgccctccacttattattttgcttatttttctttgtgcgctcctgttagtttgttaagcagatttagtcctagagtcttttctcctcccttctcctccctcctcctctcccatc

SEQ ID NO: 135 - DNA, 1747 bp, Artificial Sequence
  mscRE1017
taccctatttctgggatttaagcttcagaactgggcacaatctcaaccattatcctctgctgcagaatgaaaacctccccagccttgataagcaggaagggaggtcacctcacccgctctgggaacctgcagcctccacctgctgaggggctggctctctggagaagggaacacataccacaggggacaccccttcactctcctgtgcataaacaccctctccgctggagagctgcctaacttttctatggggttagcacttctgtctagtaggtcgcacttgggctgctctgtctgtctgtggatcttgtctctggtttccatggttcgtgtaacaagtgggactcttgaagtcaaacaggtgggaggtgttccttgaccacgcatgtgtgggatgccatctgcctgcagtcccactagcacccgaggctgaccccaggctcaccagcgtgtggctggtcactagcccgatgggaacacggcacagaggcaagtgtggcgagtcactacctaggcagaacgggaaggagcacatgaaacaggctggcattgaacttgacagagatggcagagattaagaaggcagggagaacaatggggggaaagccagaaccaggggtttgaggagaaactgtaggggctgctgaggcagagctttcctgaagggaaaaagaacagtaagaaaaacaaactccatttcacagaggcaacaatagaacaatcttgcttcttctgccctcaagtttattggcctccagaggctctgtgcttccaaagattagccttcccctgggaaattaggaagcaaatattagttctcctctcatgaggtcattccttgtagaacgcttcctcgggagctctgcgctgcttggctttcgaagccccatgcccacccggagtttcaacctggagtcagggaaaggcttagaaattatctttgaatcccaggaagacaaaacaggaatggcctcaagcagggcttccttctgaaacctggggaaatggctacttctgcctggcctgaattcaggggaacagtgcaccccacctgctccgactggcagttaaggagggccacattgaaggcagcagactcccagctgtgctggcgggacaaagccttgattttttttttttaaatctctgattagtcattgtgtataagaaatgttttgagttaaaataatatacaagaatttccttagaaaagaaaatacacacgctcattttttggatccacttaacacacttagcaaaaggacatttggaacaacatgacacgtcttagcttcggagaagggtggggtggactcatgccatcacaatggagatggatgtgtggtttattggcctctcagccacacacaggtgagtgacaggccactgttattcaactgtttaatgccagcttctcataaatcaaggtgacgcctgaaaagattgagtctttaaatcaaactgccttttcctatttcgaatataatttgggctgttgccaaggactctgggaaacagaggactacaagtgccatttcaacaagaaacacacccatttaggaccggatgcagagctcagggctccggaccacttgccaacagagtttcacagtcacatgacagtgacatactgctaatggggttagcaagtgactcatggtctcatatctggagaatgaagactggggtgggtgttagcttccaggaccgccataaccaacatgccagtatgacagactgccccgtg

SEQ ID NO: 136 - DNA, 688 bp, Artificial Sequence
  mscRE1018
cggaagagcatagagcgtgcctgtggctcacagtctttgaacatggatctctgagcacctgcaggagccaggctctgcagggcacagcggcttagacatctagacctaggcttccaagtgacccccaggaaaatcctctgcttttcctacccccatggcgttcacaggcttgcctccatcgtaaggtcaggacgtcggcaagcacagccacaggactaggccagccaactgtctctgtcccaggcggcaggctctgacgtgttcctctgggtttggagtcaaggcctgccgtgtttgttccctctcaccaggaagtgagggctttccttcctgaagcttgggaggccacgttccttttcactccccaaagaggaagccttctctgtcctcaggccagatatgtggagggctgacttcatggcctgagacgagtgcacaggaagccgtcttacctaagaagccctggaggaagcctccacaggccccacaggaagcacagccacgtcaccttctccagcagggaggccagtctctgcccagctccatcccacctgacctgccatctgcccagcctccaacccctgagacgtctcctttctggcctcctcaggctcctgagcacatttgtgagtttacaaagatcagaggtcgccggagatcagaaccagtgcaccccactgccccgcag

SEQ ID NO: 137 - DNA, 1032 bp, Artificial Sequence
  mscRE1019
tggctctattggtgctagagttgaggagaattcaaaaggagacaaagggattcttcctttgatccctgctagcgtggagaggagagtttcagcccctgaggaaccctgcagacatctctgggaggtgaggaggcccatcctggagcaaactctgctatttccagaagaacgagaataagtcataagaggccactggctggtttgtattaattgtcactattaacagtgtaaaacttcaaaggagagaatgactggcaacaaaattagtttattatactgggtacaatagaaattagactagtcccctcctcttgtcccctttaagggatttcctaaggccactgggaacaccatccctggactttcagggtgggctgcaaggctcaagctggttgccaggaagttgtgccgggccaaccccatgttccttctctggcctttgtctgctggtttcaaaggcattccttgggaaagggcattggttggtgtaaacagctttgaatctgaagagtctcacccctctctggagcacttggaaggtccagggttttccttctaggaagtgggaacaatgggaagactttattttagcagcaagcaggacttgtgataagagtgcacctcagagctggtctctgtgtgtctagttaatgaccaaacatggggaggagcaagaataccagcgttgccttaggatgaaatgactgacattcctgaagcagccccagattcctcacatcccaactggcaagactcaagttcacccacttgtgaagaggacacatgacagccctcagtccttcccttggctttcagcttattgtgtcgaatgacctctcttcaactagagagtaatgatggatgattggaccattgtttgctaggcttaactgtgtcaggggtcaagatccagagctacagagaattcagctttcatggggaaaaaaacctagaagaagacttccttcatgtggctaaatatttggacatcagaaggcagtggctctgcagaagcaatctgaaagggcagac

SEQ ID NO: 138 - DNA, 1618 bp, Artificial Sequence
  mscRE1020
tcgggaacatgggggtcaagtgagagagccaggtgtctccagcactcagcatgatatctgacacaaatcagacccctcacttttaacactgtaccctaagacttggggcacaggccagggactttccgttctaggctctctggctcctgcttcttggattctgatctccggtcttatcgacttcatttccaaattagaggttttttggaacccaggggctaccaggccaacctggaagtccgactgcacatgctgtatccgtgacagagttacagagaacagggactgccctgagtgggacaggccgaagagggactgccagagaggtacagaccccacccccacctttgtaagcctgattgcctacccaggccaccacaactccatccagctctgtccccgcctttgttcctgagtctccaaggccccctttcctgccaaacaaagcccccagccacccgactgccgcccaacaggcacctggggcctctgggcctgggaatcaaagcctgttttgcaaaggaggcccagtgtttggagaacacccatcccctgctgcccggtccttcaaagaaccggcattgttctgcgctgagaaggcgcctcttgacgcgctgggcagggtcggcttgacgctggtggacctctgatctcaggccaggcccccagccacttggggggagggtggacttaggggccaaagagggagcaacctgtccttggggcactgtggtccttcctcattctctgcccacccgagttcccatcaccgagttcattgagacccaggctcttctacctggtgatctggacaaggcaggcctcaggaggcaccaggacaagagatgagatagcgggcaggattttagtgaccataacaggtacgtcagagactgcaaacgtattaggcctcagtggcatgtaactgtgattctagtacttgggatgctgaggcaggagaatcatgagtttgaagttaaccggatcttcaaggcaagaccctgtctctaaatcatagatcacaggggagtgtgtgtttgtgtgtgtgtgtgtgcgtgcgtgcgcgcatgcgcgtgtacacgtgcgtgtgcatatgtatgcatgttctcattttacagctcacagaggctagagaggaaactgggcccagagcccggttcaagctgtgaactgacaggccccgttggctcttttatttgttgaagaaatatttcccaattactttcttgtccattgtggattccactgcaagctaacattagtaaaggcatttaaataaaagtctgcccagacacaaactaaggccacagaactggctgtggtgcccaggcgggtcgtgaggagcccaaataacactcaaaagccacctttatttgtccttcccctctgccagtcacagcatcatgagcttctggggtggtgtgtgtgtggggggggtgttagtctcactcctgtggcactgcagaagtctctcaaggcacagagagagggcaagcaatgtgttcaaagtcacccagaaactgaggttagattggagcggagagcctcatctcaggagctcattctgtccggtcctcccctcagatcacacttctgatcaagtggcacggcagacctt

SEQ ID NO: 139 - DNA, 1458 bp, Artificial Sequence
  mscRE1021
agaaacctgtaattttcacattcaaatacaatcctgcggacttttaattaacctaactgttcctacaatgcttgctgagtaccatgcacctgcaggccagcactgtggccttgcctcctgacgcacctgcagatctcatcctgatgctctacgatgagtagctaagggagaaaatatgcttgctggcaggatccccttggggataactgtaggccggtcctatttcataaaatagcacacagaagtaggagactatcggtgagtggcagggaaagcaggcttcacagagatgttgagtaactacaggatgtttagtctagagaagaaagattatggggactttgatggttgttttcatcatttcaagaactattgtgtgactacaaggagaatcttgagacctactggggctattccagttggccaatagagtgagaatgttagagagagattcgttttgatgtcttcggaagcctgctctaaaggtatctctgcctgtgagcattccagaagctggctgaccgcccggcctataaagaaacaagtttttgccagtaattccagtgaatgatctttgaggactcctcagacgttactccttttgttcttgtcctccaaaagaaatggaaaataacaacactttccctgggtcttcctgacgctttcagagtgacaagaatgttaccacagggcactgtgtgttcccaccttcccccaccttcaatggccggccactgcagcaaccttgacttagttaactgaatctgttacagtcaacagaccttggtcccagtgacattcttcctgccctggtcacatactgctgagcctgtgaaccgttactaagacctcaactgtgattgctttggcccacccactggacatacaaattctagtgctgaacagaacagtcaagaaagagggggtatcttgcctcaaggtgaggtaaatggtaggaagacgttcacagagcagtgcccacgagaggcagtgcacacaaaggttccacgtacagcccacagcttgacgtaggagtgtccattctctgagggaatgtcaaaggaagggaggtgcctctcagtgccctgcagctgccctaatcttgactgtggctgcatctcccaggctttgcagtctagactaccatctcctgaacacctgctttgttttttggttttgttttttttttcgtaaaactttcccagacgtcatcacacaacttggaaaagagcgtgtctcctgagttgccatttctgttgtcacgttctgaccagccaacgcttggaaaacaaacatacagttcccgttggaaagactgtggtaatatttcttcacagaagtttgctacctcaggaaaccagttacctctttgtttcttgctggatacatggttttggcaccatgtcaaacctgcctgaggaatcactgtttacctcagaggatgtagccttgctgctt

SEQ ID NO: 140 - DNA, 987 bp, Artificial Sequence
  mscRE1022
cacctcattaactcccaggcactaagcttagatcacctttctgtggtgacctttttagctcccttccctttctccaagttatcttccaggggaaggagctaggcctggtcttaggggacaggagtgagccccttggggaccagggctgggccctttggctgccatctggcagtacagtctggagcctcccaagcccctgctgtgaggcctctggggtgaaagtgtctgtcaggctgtgaggtgggtctgtgcccagttcactctgactatccagagacttgggctgttggcctggctcggagaacgggttctgctgccctgggcacaatgcagagcaaagaggaaagaaaccttttccaaagcagaggccaggaggaagcacacagaggcctctttgctttggaaccgaagcctttcaggtctgttttctttaaatatcctgctacaggaaagagaagcccaaatccagacattcctaaaacattcaggtggctttaaagcagcagtttgtttgatcttcaccccaccctgtttctgctcactggggtctctgggacctactcctgcctggagcttggttggaaggtccacacccttccaagttcactcacatagccgatgtaccgatggggcctgagacctgattggaacttgctttttctactttagtctgtttttgttttcgtctgccgtgctgaagatcaaactcttggccgtgtgcatcctaggcgctcactaccactgagtctcagcccctgcccaggttttgtttggtttggtttgaagtcacttttctttgatccccagctgtaatggcatggctgaccacacccttttcctggaaagtctttcccttgacctctggggtcagacacacaatgacttctgactcagtgctctgcctcactactgatcactagacctaaagtcccatcatgaggcacctgagggtctccatcacttcactggtctttaacccagaggact

SEQ ID NO: 141 - DNA, 683 bp, Artificial Sequence
  mscRE1023
ggtaatgtagcccatatgtttacagggtaggctcgataaggacgatagatacatatacatctactgtgttacctggttctaggacccacttcagtataggaacaagactaaacagaaattgggccgcatcccattgcacacttccttagctctcatctcctctactccgagacacggagtgctttccacagcaaccacgtaggtgggagctggagtcatttgaggtcttagggccaaggcggtgcttcgcctcaaggctatgcagtttccaagtccagacatctggattttagggtctataatggaaactcagtcggggtcatggcctctcctgggaagagtctccagaattttgtaacaggactttctcttagagatcagtgtgttgtggcgacatgggacaatgtccaggcttctgctgccagatgttgggattgttgtgatccatggctttctcccaaaccaaatcatccgccccggagtttccataaacctttctcaaggggtgtgagctaccagaaagatcatggtgtgtcctgggtgctggcctttgagaacccacctagccctctccagcctctccctcaggctggaggctggaggaagattatttttgtacttgagtaactgcgtcaaccttaggagtaataacttggctatgactctatttatttattcacaaa

SEQ ID NO: 142 - DNA, 723 bp, Artificial Sequence
  mscRE1024
ccccaggaaagacgtcacaaagtctgtgaataccacatggaatgtgtttagcgtgttccttgttgaccctctgagattcttgaagagcatcccccagtgatctaagttcctcacagcgggtcccacctcctggaggttccaggaccttccagtacatcctggggacaatgtctttagcagggaggtcttggggggacaactaaggtctcaatgataacaccacccttggattaaatacgcaactagcccacctgggcttggtcactgagccctgccccagtcaagacaaaggactaatgtctcccagagggcttcaggagcagcccgcgaagacggacaggcagggcggcaaagcgagcacagcgcctcacatccggaaaattattagacttgtatactctagcaaattctttccagtccacttttagcctggcactgctcacaccactgactttcaggcttgagcagggacatgagccaatgaaaacgaactgtaactcatggacgcagggataagagctctttgggggcggagccaatgaaaaggaactgtaattcctggatggagggatgggagctctctggggggcgcaccgctgtgatgcacacgtggtgagtgcctgggaattggtttcacatgcattttgcctgtgtgaaatacagacggtgaggttttaggtagcagaacacagctttctctcacttcctggttcattcaccgaa

SEQ ID NO: 143 - DNA, 373 bp, Artificial Sequence
  mscRE1025
ccccacaaccagaagcatgtctcccagaggccaggacgcatcgtggagctggagtcctggagccagaatgaaggagagtccccaagcctgggatgtcacatggcccagccttcaagcaaacatgtaacacccacttgggacttaggaatcattaactggctctgtggcttgtaaaataaataaataaataaataaaccttcctatttgtttaacctctggagttttcagtttcctcttctcaatgaaaatgagccaaccttcccacttttttttttttaagcaggggacattgaaacataccgttcttcctctctgcaccaaagaagatcaggaagtgactttttcccattatgaaatctcagtgatggccca

SEQ ID NO: 144 - DNA, 329 bp, Artificial Sequence
  mscRE1026
gttgcgtctgtcagggacagctctggatccccagagccagatcgtgctctgtagctcccttaggagcaactatcaacagatccatgaccaagagggccccaagattcaaagactgttccagtctactctggatttttccagctgtttttcttggccagaggatcacacccatcgggatgcaaaccgagagcaggaagcaagcggaacagtaaagtcagatgaaccagaggagaggcagatgtcacggacacgaggacggtagcttcgagcagcccaaacccttgcaagagaacacccagaggggtatcttttcaagtgcaggttgtgct

SEQ ID NO: 145 - DNA, 325 bp, Artificial Sequence
  mscRE1027
agggagacacacacagacacacacacacagagagagagagagagagagagagacagacagacagacagacagactgactgactgactgactgagggagcagctggagctcaagccccagctcatgtggaagtatccaagctgctgttcctcgtttggttttggcatgaagcactgtagtgtagtagtggaaagaatggaagcgatgcactcttctgttacatctaaccactacattaaaaatggatatcctgatacctgacccgaggcttgacacaaaacagactcactttacaagcactgcaggaaatctcagaaaagtggaga

SEQ ID NO: 146 - DNA, 194 bp, Artificial Sequence
  mscRE1028
tcggtccgcagaggttccctctggggtcaagccctccaggccgatgtcgctgtcctgcgcgtcctgcatgatgtgttcgctccggacgccctgggtccagcagagggaccggcagaggcgggaggaaggttgagcccagctgcctgcaccgcgctgctccgcccccggcgctctagtcctggggtcccccagtt

SEQ ID NO: 147 - DNA, 625 bp, Artificial Sequence
  mscRE1029
ctggtacatctgtgttactgctatgtgaatgagccctgtctggctgtggcatctgcagagctcagctactgcctgtctgaaagttcttaatcatttttatttttaggttgtgttgttttgttttgttttgtttttgttacacagttttgggggaggtaccatgtgctagaactacttctaagaaaataattaaagacatagtttctctggacagaaatttgatcctattctttgtgtttgatatgtttttatttagttcacgaataataatggatcctggaagcatgtatctaagtagattgaaaggttcgaaaatcaaattttggaaacgatcgtttacctcttccttccacagaagaaaggctactgtcttgaggacagctaagtgaccacatgggcttgattactgaccacagagccaacaactgcttgttttggctgcagctacttctattttagctttgacagtacaccccagagacaaacttaaaaaagttagtgtgggaactgaaaggccacagtttctcattgtttgctctcacccattgagccctaagtcagggtgtatgaaatcacttcacagtggtcagcacagcaaatggacaaggaaagctctggtgggggg

SEQ ID NO: 148 - DNA, 492 bp, Artificial Sequence
  mscRE1030
tgagaggagaggagaaggaggggtggggaggcaccagaattcctctctgcgcttctggaagcacattcctaccgtcgttatgagctgactggggatttgggaattgactgccagcatccttggatctctctcttcagcttggccactattctgaccctcgtctccccggtggattctttctggtccctgtgaaacagaagggctgtggacctagcccctcctatagcaggcctcctggattacttcctccatctgttctgcctcccaccctcgggtcaagacgtcatcgtcctcagatcatcatttggtccaaggatttctccgtgatgctcacaattgtttactttcctctgtgctcctcttctggccattccccggggtcagctttggactctctggggacaaacccttcccttgtcatcctgtgcttcccacacccacgaggtcaccgtttcatggactaaatggataagtgacaaggacaatgaagag

SEQ ID NO: 149 - DNA, 625 bp, Artificial Sequence
  mscRE1031
ggtgtcctgtgggtgccttgagggtaagaggctcaagaaatcttcaaagtcagactccattcaagagctgaactaatgttgcctgccactagcgacattaaccctcagggagggttggacaggatctggggaagctgcaggtgcagagtgcactagaatttgaaccccaggatacagacaagaagctgcctaaaggcagagagccctgggtaccgtggtcccaggaggccaaagccccggaggtcacagagctgagctcattcttcctctccagctgcagatgttgtaagggaaaaacaacaaaacaaacaggaagttctgaggatggtttcccacgtgtttctctccatgtttctctccagtcactgcctcgtcacccaaaccagttttctcctctcagcctcttgtgctcccagatcaggcctccctccctcagcccagatgtccccaacgggggtggggggtggtttatgcttcgcttctaggatgcctgcatcttagaaaggcaaggtggcaggctgcacaggcaactgcattatcatttcttaatgtcatttttttctgatccgtatgatgggggaaatgtgctgggtgtggctcactcctgtaatcgtagcactcaaga

SEQ ID NO: 150 - DNA, 423 bp, Artificial Sequence
  mscRE1032
ctctcatgtgggattgctcacagttagctcaaaccttactctcagacttcagaatccctcttggacagagcaggaaggaagaccatagtatgtccagctgtacaaatggaacacagacttctgatttcccatcatacggctaactatagaagcagaggacaccacactgcgtgacactgaagcttctggcctttctcccatgacccctgcttccacatgtcataacagtcccacagctggaaactagatggtcttcagatggctctctctacccagagaacatcatgctgcacatttccaggagaaaaaaccagaagtatgacaaagaaaaacgacaggagattccttcagagtacagactcctcttagaacaatgaagatgtttgactaaagcactccaagttacttgtgcaatgtgttgtt

SEQ ID NO: 151 - DNA, 359 bp, Artificial Sequence
  mscRE1033
ttagttttcatataaagaaacacatttgctttctgctctaatggttctcttaggaatcctgaagttctcaggagaatcaaagcacagatgtgagacagcaagttatactttcattcaggagagaaaaacttgacagccaagagaaaaggaagctgctctggattcctgtctcctgcagctgggaagttttgcaaaggtccccagggaggaacagggccaccaaaggctgagcaagagtgactcgggaacattctgagtcaagcagggactggggaccagaatgcaagataaggcatggaattagcggaggccatttcccttgcttctcagggacctcctaaaacacatagtccaggagg

SEQ ID NO: 152 - DNA, 661 bp, Artificial Sequence
  mscRE1034
cagctgcttttcctgaaggcagcttcagcttttccaaagccagggtgctgctgtggtcagctagtgctgcactaaatatcctcttccaaggggctctgatcctggctccagcccctctggcctctgggactggttttctctatttcctttccttctccaaggttagcttttcagactcaacaacataaatcaagagcctctagggaggtgaacagaactggccggagaggaagcactgcttcagtgggggaaggggaatgtcctggactagcaggccccagtaggggtggagtgtgggggtatggtgcatactcagatgtctccttggaaggagtgggtggcaaggattcttccataaactgataagccgggacacagagtcccatcccccatccccaccctgttacactgctataaacagagagggctgaaggcaaaaggaccctgcttgctgctgcagctggtccagtctagggggctcttcagtagaggacagctctcttcttgtcacgtgctttcctctctgaacagagctggttgttttggggcacttgggctcctgtggactaatggggtcaaggaccaggccagacacacactaaggcctggagtccctggggactagtggttccagttcactaacctctgcccttcaaatctg

SEQ ID NO: 153 - DNA, 477 bp, Artificial Sequence
  mscRE1035
cgagacctaaacagccgccgtggaggtcatagtcctagtcaggttcctgcgcagaggccctaagctgccgagtgacaagcagaagggtgagtggaggcaatgacagtcatctggcagggaggaggaacgccagactccttggaatgctgtggtggttttctttaaagttgttccccatgggaatcaaggcagtcatcccagggggtggggggaaagggtttaagacttccttcctcagaaaaggacactgctactgtactgcagctgcaagggaatgcctgctatgttgtggttgatgctgacccaggatggaatgcagatgaaggatgcttttaggaaacaagtctgcttggaatgctgggtggcaatccttagcttttggtcgagtggaagcctggcctcacttgtcaacaatgaaaactaggttggttagaacctaatagactccctggctcctgccccccatgctcactgtta

SEQ ID NO: 154 - DNA, 667 bp, Artificial Sequence
  mscRE1036
gggtctccctagcccaacccaaaagagaaaggatgcaggaaggatgtggagagggaggcaggaatcgggccagaagcaccctcaagtcctctcctcccccctcctccctcacttccacttgaggagtcctctcttttctctctccctctcccctcctccttccttcccagtcctctctcccctcccccttcccttttgtcctccccccttcagcaccccctccaattttctctcctacttctctctccccttcccctcccccctcccccctcctccctgttctttctccctgcccaggcccactgcctcccctagcccctgctcccagaaagccctggaaaggcagctttctttgagacaggaaggtgtcctcaagtctcaggaaggaaaaacagtcgagctgaacccaagaccgtctccaaggggctggggctggctccgggccagggctgacatcacctgggaaccactgcctctgcagctgcagcccgcctcctggggggatgcttctgctatttaaaaaataataataatactaaaaaaacttttccagtctggtgtttttaaatgtgctttatatagtgggccctggggtgtgggagattcaatcccctcccgtttgtcctcacagcccgggtttctcacaccgcactgggcagccttccga

SEQ ID NO: 155 - DNA, 642 bp, Artificial Sequence
  mscRE1037
agtaacttcatttccctctctaaatttgggttccttctatatctggccaatggtcattttcagaaaagaagggcagtcctagctgcaggagcactttaaggagttgtttattatgagtaacagatgtagtaggagaggtgagactgagtacagacctttctagacattttctacaagaaatcctggcagctgtaattcccttaggtggctggtcatcatcagaaggcctctgagagatgatcaagaggtcaattttgacagaaaatggtaaaaatttgtggattgtccgtattacttcccattcctgacaactgttccttcttaaaggccagttctgaaaggtcagagtgtggaaatacatgcgccagaaaaaggcttgcagcagggctttttaccataaatgctgcaaattagtgcttcaaggtcccagtgagaaaagaccttttaactttctctgctgttgacatcaggataataactgtgggaagagtggaagggcagatcctgtttaaaaaagaaaattggaccttcagggagaaaaggaaggatcttcgtatcctttcccacaaatgcaagacaattgtcctaggaaaacacagcctatgatcacagcacagcaaggcaagttcccagaacatctga

SEQ ID NO: 156 - DNA, 548 bp, Artificial Sequence
  mscRE1038
gccgtatctcatttttagacatttaagttacttccaacttttcctgcttatcagttacgtcagcatggctatttttatacctagatggcctgtgttcctgactgcttggaagtagacttactgggtcaaaggggatgccagtgtgattttcagaaaacgatgcccgtttctgttcacagctggtttctataaagcatgggaacggcgcaggcactatttatgtgccctgctgaattctcagctccctgcttcatctgaccttccgccactactcagaatcggctctgttcttctcctgggctcccgatgggagccaagctggacttgtgtcagtgtattaagaagtgctcgttatagctcattgcccatgggatgtcgactgctgctgatttctcagggctggagatgacacattttctcacattcttcaaaagtcttaaggttcagcaggagagaaggaaggtccgagccaaggagagctgcggccataccgacagggagggcactctctctttctctagctctccccccccccccttgaaaagggg

SEQ ID NO: 157 - DNA, 707 bp, Artificial Sequence
  mscRE1039
gcagggcatggtggagcatgcttgcaatcttccaacttaggaggcaaaagcaagagggtcatcagaagttcaagtccattctcacctacgtaacaaactttatgcctaggctgggttatgtgagaccttatctcaaaatagccactcatgtaaacaacaaagaaaaaccccaactgtttagggaactctcacgcttcaggagccataccgaaataggaagaaaatccttgtggcacagtgtttctggacagatgtgagaggaatcagttgagactaagctgacctttagtttagttgcagctggagctcagattcatcgcctgaatattatttaactagtttcctggcgaagagcttccatccaagaactaaacatgttctgcgctgagcatgaaagacccaacctttgattaatctttcctgttcaaacttttcaccactgcggagcacttcccaaacacaagggttcttggaaaagagactgcacacttggttaaggagccagagaggagcaaactgcaaatgcttgaaacagcaccacccaagtcccagctccctctcagactccaggatttggaatgctaatctgaggacctccttccaccatggatgacaggcagaaacagaaacctaatacagtcactcactgaggtagtaggacacagcatggttttttttttttttcccagcactttccttaactcttt

SEQ ID NO: 158 - DNA, 485 bp, Artificial Sequence
  mscRE1040
tcatgaggaacaactgaaaactgtttgtttccctgaatccatgacaacaggaacttagtccaaaactcagccatgaatgttggtaacgtgggcactgcagcgacctgaaagaattcgggcccggcttgcatgttgaacacagagttgccagtggcatacttttttggtagagaggaatagaaaaccctggcttcctctgagaattgaatgcctcctcccaatgcagtccaaattccactgagaaccttaaccttataagggaaggcagcttttgagtcacaggcctttgctgtttctttctcactggctggcctggaatgagcctctgctaaaaatgttccaagcagctattgacctagacatttctctcttcttttctagcaacttatatgtgtgtgctgaaagaatgctgcacgttcctgtgacctcactcacccctctgagtgccttcttggaaaggagatgtaggtggagggtttcccaga

SEQ ID NO: 159 - DNA, 523 bp, Artificial Sequence
  mscRE1041
tcctatgagaaccacagtgtcatcccatctaatgactgacagcatccatccatgattcctggagaatgggcctctgggtgggactgaggcagcatctctttcatgtgtgagaatggactcaatgacctgccaaggtctttttctggtccatggctctgggtacagctgcaaaaataaacttatggttacagcaatggaaacaggcctgtaaatacaggtcgccaggacgcaactctgtgacacaggcaatgacaaattcccagtgtgcatttgcgtgacttgcacattctctctgggaaagcctgccctgggatcctacaaacagaaatgtgggaatacttttgtccagtgagtataatgccacaggccagacttgatcttccctccatgttccctcgacattttggccagagaccaatatatctttagtaattcctcaagacccatgggaactgaatcaagggaggctctccacatcacacacacacacactcacacacacacacacacacacacacacaca

SEQ ID NO: 160 - DNA, 474 bp, Artificial Sequence
  mscRE1042
ccagggcggtcccaggcctcagagctccaagggacgggaagtacccagtgaagcaagggacagccctggtggaataactccttcacagctccatcccagaagtcagcggccacccagggcagctggtacaccacagtgacgaacctgattgccagtcagcctggcagccacaagaatggggtaattctacaaggaccagggccagagctgtctgtaaggggttaaaaaaaaaaaaaaaaaaaaggacactcctcggtccccaggagttaaagggaatcctggcaagccacccaggagaactctctggaggcatgtttgacttttaaattccaaactctagctgccccagtgcttcagagagatgttgccaaacgagttcaaagagacatgcatgggtcaaacagtaaccactctacaagagaagctgctttgtgtgttctgaggtagctgataacatggacacaggaatactct

SEQ ID NO: 161 - DNA, 455 bp, Artificial Sequence
  mscRE1043
catcgcacagcttagcctgtggcccccggagtttggacagtgtccctgagagagaagttgaggtgctggtaccccgtccagcctgcctgtccggctgtcctgctcctgccaacccaggcctactcccaaccccccaccaccacaggcaggcaacttggccctgggatcggtacagtccagtacacatgtcttgtcaatcacaacttgctcaaaatagttgctggctgcattttccctcccccaactgtgttactcctagaactaattatagtacaaatttctgccttccatgtcccttttactgcatggaccttttagtcaggactcagtatcagatctctgggttttttaactaagtgatctatcaggcaccatgccttcctccaaggatcatgaacctaactgcttttggccaaagtccatcggaaagtgacatcaacagagacttcagtctc

SEQ ID NO: 162 - DNA, 518 bp, Artificial Sequence
  mscRE1044
cctctcctcctctttgtttttcttctgctggcacagggctgggagagccagttaacgcagatggtagtgcagagagttctcatgaccccggttttattagctggggaccaggactttctaaatgtgcccgtgtttgattgtatactcatgttgcctgatttagccacattacttctgattgcttcttagtgattttcccactgaaatttctttcctattggttttgtagaggtatagttcactcccatctctatctgaatggcattctccaacccgagaagcatgctgggaacgtgggccagggaaaatgcgctcccccatgccaccatgcccgcctgaagcctgtggtttcacagaggattcttcggtaggcgctgcttgagttgtagtctgatgacggtgacgcttatgttccggcttccctacagtaactcttcttggctgattattgctagagaatctcattggaggaaagaggaaaagacggaagctgagacctgtttgtgcttcccctgaac

SEQ ID NO: 163 - DNA, 367 bp, Artificial Sequence
  mscRE1045
tgtgtcaggctggcaagttagtgaacctcacctcccggtccctgctaccctggcttccagtgtcctgcggcttctgccagcctttgcatttttctctttttctcattgcgtggcccccttgtctttaaaaggctaaactgctctgtactaaatttggtcacgcagcgctccaagattccctggaatgtcctcaagtttcaaacagctctgaccgtgaggcaggcccgccccctggcttggggattggcttctcctctgtggctgggcagctgtcaggttttattggttgctggttagaccaagcagggtccactagcagggaggctgctgtgtcccccggagcacctgtagtacagcagggcccaaa

SEQ ID NO: 164 - DNA, 388 bp, Artificial Sequence
  mscRE1046
aggaaggctggggttgtcttaacataaacacagcttaaaggaactattctcaaatctctctcctttctgaccagctacctaagtcatcaagacaaactcttcaactggcagaaagctggcctagcctcactatgcctcccagcacactgccttctggggcagcaagtgcctgggaacatcgtagaagcacattcccaggacctgctgggctaaggcttcacctcacatggtcaccatcaggccgggttcaggcccctcggggctctgcttttagcagcaatgggaaagaggcacagggtaagagagtcagagggcgataggcaggtctgcaaagcaaacactcagaaaattagaaatagctcaagaaacaaatgccctgagaaagtat

SEQ ID NO: 165 - DNA, 662 bp, Artificial Sequence
  mscRE1047
cattgtgaaacacaccacacattgcatggcagccccagcagagtcctaggtattccccaaggaccaaatgtactaatgtttttctgcagagaaacataggacaactcacacgctagagaaaaaaattacaaaggttacaaatagctttctctcgggatttgctgccagaccagttgagagcatataaggtcaggttcttgctctgcaaggtcccaagttccaagttttgagaggtttgggattttgcaattgggggtaaaagggtattgacccactgtacaaatgacttttccctggtattcccattgggtcctagcacttacttcaaagaccttacacattctcgggggggggggccctctgcaggggcaacaagcaccagtttgttactccaacagcagaagccatgggaaaattcctcagagcagcaaagctgccccttccagctctctgtcacagagagtgctgccctttcctgctcctaggacgcggcacttatggccatgatgacatcatcatttaagatagtcactaactgacccacactgttaccatcctgacccactcctcaaccatcctagtaaacctctcttgataatggattaggcaaagagagtgtactccgctgttacccagaaacctcagggagagagagatcaaat

SEQ ID NO: 166 - DNA, 442 bp, Artificial Sequence
  mscRE1048
ttttcttccaaacggctatgtgtctgtacatggactaacttatatgatcacctgtccagactcacaagccttcagccctccccagcctccctacggctgccacactggccaggaggggctcttctgggcaatctggccctggtcccggcagcatgacgctgagcaaggcaggggtgtggagagctagtctgtgtacccttcaagggcagccagagacaggaggtggagcctcagctggccagcaggtcccacaggccactgttgcagggcagcaggtcacatgctaggcgtgctttgcgatcccggacggccttcagggctgggctgtgttgtaacaggagggagcaaatgtcctcgtgacccttctccgcagcctgggggggggggttgtgggggggagggagggagagagagagagagagagagagagagagagagagag

SEQ ID NO: 167 - DNA, 516 bp, Artificial Sequence
  mscRE1049
aaattctgtgttgtagagtttattttccttcagtgtgatagtcagggtctgagcctgcctcacagtgagcatggagggcagttacagccagcatggacgacctctgtcctgactggaatgtggctctggaaggttttttttgtttgtttgtttttttggcttctgcttctatgccacgactcttgtacccagtgtagagaacttggtgtttcccctgggggtgctacacatcacccctctcctagattctggcctcgtccccttctcaaggtcatcagcactagggcaggcttctatttaaccttggacttaattctagaagccatgcctctcccttcttgacttgttgccattaaaggcactttgcaaagcttcttcggttccctggcaatcttgcagcagcctgggggagcccttgtcttagctgctcctgccttctgccctcctttctctaaagttttctttctcagcgcccttctctctgagacaaggctgctctagggcagtcctcccctc

SEQ ID NO: 168 - DNA, 492 bp, Artificial Sequence
  mscRE1050
atttttacttgattgttttgcctactgaatccaaccagtaaaagtaaatattctcccttttccccgctggagagaggcagatagaaccagttctagtctgggaactacttcctggttgcacaggagcctgctagagcctcctcccccgactcagctgggcacaggaaggtggcttcgtccctaaaaggtagcgcccgaggtctggtgaggacacagtgagctggttggccatgtgaagtgagccagaggaggagaaggttgaggtcgctggtccttagctctgacctgctgttcccggtttccttcagccaattctcccttcgattatttttagcatggagcagcggacaaaggcagtgggccagcaagggaagatagatttctatcttaaccaggccacttacacgggacctctgtcttctagtctgtagagtatagtagatagtcccagcgctttaccctgtcactgttaaaaacactatgacctgcaca

SEQ ID NO: 169 - DNA, 378 bp, Artificial Sequence
  mscRE1051
caatgtaaatagacagtgactatcccatcctgtaggatggtgggaactggccaagtcttttttcttccccttctttcccagtgtttagggtccttcagagagagacactcagctgcccagatctcccaggagcctgctactggctctgtccaaataagctcagtaaacagccccagggtgctctctctagctcgcttgcgctctctctctctctctctctctctctctctctctctctctccccctctctccctgtatccctctccccctccctccctcccttgtcagagtgtgttgcagcttttcaaatgcttagacaaacatttcctgtcctcaggggagtgatctgagctctcctgaggtcctgaccattgccca

SEQ ID NO: 170 - DNA, 377 bp, Artificial Sequence
  mscRE1052
gagaagaatggcaagtgtgtgagagagggcaaagcagaaaagggccaagcgggtcctcagggagaagccacagccctctccagcctgtgctgtccaggaacaaagctgccctaggcctccccaggggctcactggccggtctctgggtttccccggctaagagctcccggcacaggggaggagccgggagtgggcggggtcgtgaacacgggctggggcggggctagagggggagggctcagccttagtccctttgggtgtctagagggcggggcctaggctgatggagatccgtgaccctagaggatacactctgaaggaggtcagggccacgacagagaaggggaggaggcaggcggctgtgcaaataaaggttt

SEQ ID NO: 171 - DNA, 1699 bp, Artificial Sequence
  CN2084
gcggccgcacgcgtcattccttcagagaaatgtttggggtaagggatggaagtggaaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctgatcagtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 172 - DNA, 1680 bp, Artificial Sequence
  CN2085
gcggccgcacgcgttgcagagggaagatgaagtctttgatgatagccaacttagtgtcaataagtggctttctttgagacatattcagatgggaacgtcttgcttgccaattgccatagaaatcttaacacaccatgaagattgtccaagcgccaagccttccgttctggactaaattactttgaagtggctcaggacgagcagtggtcaattttaactctatagactggacagaagaggctgggagtgggagattgtgcgttttaaagcagaaaataagaaggggaaacttgttttatacactctatacaagcttctgctcattgtcagatatctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 173 - DNA, 1915 bp, Artificial Sequence
  CN2086
gcggccgcacgcgtaccttgatgacgttgctcttccaatactggaattaaaatgaccagcttcggagcagtaaatacaacaatggagatcacacagttccaaccctaaagcacccactcaccatcctgctttgtcaagaactgagctgtttctagggtacagggcttgtgtttttcaaacagtagttgtgaccacattcagggcaagttgaacaaccctgagccagaattctatggcaactggcagcccttccccatcagcctgaagaggtctattctctaagcataaagcacacatgacagggctggtcaccttccagtttttcaagccttctccttgctgacctggccaacaagaatacttgttggctgtgaacggtcagaacatacacaattaagtacaagtgaaggtggggaccatgtatatttgacaaaagggtcttcagagaactctttgatgtctacatcaggggtttctaacctgagatagagggtgaggggcatccatgaatttgaaggggaagattgcatctatcatgacttatacccatatttaccccaaatacacttccgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 174 - DNA, 1574 bp, Artificial Sequence
  CN2083
gcggccgcacgcgttcgtttgcttcctaacgtgccaggactctgctggttccacatataaaaacaccccctggagatttcttcttattttacatagccctgccgagtggactggccattctatgaaaattggatgaaatgacactaagtcttgttgcagatccatgaataaaaggggatacctttctccctgatgaataaagcccagcatagggtatgccacagtgccttgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 175 - DNA, 1786 bp, Artificial Sequence
  CN2087
gcggccgcacgcgtagagcctaaccaggtccacctggaaaatgcgactaggctcagcacaagctgtgctgcactgtttgacctggcaggccttcaattttggggggctgaattgagtctgcttttgtttctcagggagcctggaagaaagaggacttgttacagaggaggaggggagacaaggaaggaacgagttaagccctaggcagcatcagcatctttagttctttttctttttctctcttttcaaatgagtacaccacattgaatagcgtgtggaaaattggtctttccattgaatgaaaacgaactggcaagcaacaaaacggataaaggagggatgccgctggatgtcatttggtttcgcgcttggtttgtcagaggaggaacccaggaggatccaatgttttaagatgcattttacctaaagctctggccctgctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 176 - DNA, 1686 bp, Artificial Sequence
  CN2088
gcggccgcacgcgtacagggctggggatcaaagggggccagcaccatgtctagagggcagagatcctgccactggctggtggcccctggttgtcttggaactccacctgctgttcatcagcagggctatgggaatctggacacacctcctctggctcagaccaatcccagctgctgctggccagggcgggcctgggccatgggatctggaggaaaggtcacttgtgactggaaggacagtgggcaggaagaaagagccaagctagagtaggggagggcacccctccttgtcctctagacttcctgttccatctcctgtccctgtagggctccagctaaaagcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 177 - DNA, 2054 bp, Artificial Sequence
  CN2089
gcggccgcacgcgttccagaccttgaacataaaaggcattttatacccgcaattgttcatttaatgagcaattgcggagtgcaggccggttaagggattgagctatatgcactattattgcaagaagtattccgaaataccagaaataggacgtaagctctgatcagggagactgcgagcacaattaccttcttttcaaatccttctgtgacactgcgggaggaaaaaggactttgaaacttgaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggagagaggtgaatgagaagtcgctgtgcagttgcaaattctggcaaagaaaaaaaaaaagctcaccccttcctttattttgtaatatgcattcctgtacaatcctgccagtggcaatctgtggagttcagtgtgtccctaagtcaatatggagtacttggtttatagcaactcttgttaagtttgtcttgtaattgaagctgctgttgaccttgcttgggggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 178 - DNA, 1671 bp, Artificial Sequence
  CN2082
gcggccgcacgcgtattcaggaccagggccacagctgctgcctctttcccctccagccatggtctgagctctgagaattctagatgggccatggcagtgagcttgggaaagattgccaggaagacgctgagacctggctcccaggagagaggtgtgaggcactggctggaagcccagtgcctggctgccctggtttcctggggcccagacatgcgtgattagtccacagcaaaagcctggccagaagtcagagggggaggggaaggcagggggaggatgctctgagtttggcagggagagaccaaaacagagtggggctgggatgaggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 179 - DNA, 1878 bp, Artificial Sequence
  CN2090
gcggccgcacgcgtaggtttgccctacctgtgggaacccagctgaagagggtctgtccataggttgggtagatttgccctggacaagaacgaagaatgaacttaaaacccccaaacctagagttggtttctaagctacttagccaataagctcttcgtgtgtgggactgctgtgactactgctctgtgcctagctccaccaccaacaaatatttccatgaacaaggcccatctctgtctggggacaagcatgtctttgtgatctgccaacctcctgaccacccacagcaggccattcaaacacagggcttcctataccactcagaagaggctttcccgtctttcttagaaaaagatataaaatagttgacttctcaaggtaattggaggaatgacagagaagctgagatgtcccttctacctgggtgacccagcacaagatgcacacttaacctggggacagtgatgcttagccaaagtggctaaatctctgtgcaaatcccatgaagggaccctggacatgggtgaatgccgagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 180 - DNA, 1860 bp, Artificial Sequence
  CN2091
gcggccgcacgcgttcacagccctcagtgactgctcctccactacactatcgggaaactgaggcccagggtggccacatgacccttcctggggtctcccctcactcggggcacagctaggcagatgagggcatgcagaacttggcctagcatagcctggcctagctcaacctccacccccatcctggcccttctccctacactgaaagagactttatggggataagaagtcacccattgtgtcacaggagacaaaggggcaagagacacaggctccaggcgcctgggctggccataccaccaccacacaccacccctctctgtgccaaaggagggctggtgaggcaccttggaattcctgcactggatattttagaacatggggcggggggaggtacaccatgtctagatctccaggaagcccaaagccaccaagctgtccctttctctatctgaaacagacacacacgagaaaccagagtcactcaagccagcacactctctcccaggaccggttgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 181 - DNA, 1738 bp, Artificial Sequence
  CN2092
gcggccgcacgcgtgcttagagaagggcctggcacacagtaggtccccctgctgggctagatgctattggtggtggctttttggtgcttgccttcctcctgccccaccctgtgctgtctgccactgtttgcacattgtatggttcttttcatgaggaatgtttcaaagagcatgacagaatcttacaacaatcagcccattgtctgtgtgctccagagccgactctgaggtcctggggtggccggaggctgtcagggaagggaatggggagagaggaggcgaggcttgggtgggcagtgttctgaggggattgattgccctcgggagttgtggttcttgtgtcagaatcaggccttttgttcaggtctttttatgcacaagctatttgggacccgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 182 - DNA, 1847 bp, Artificial Sequence
  CN2093
gcggccgcacgcgttgcctctcaacttctgggctttagttcctagccttggactggagaacaagactccccaagtcccagtctcagatctgccacttttcctgtttataggatgaaaaacacagtttcccctgaaggacaaggagactcaaaacatggagcgtcccagccttctccgggcagtcctagactctgtttgtctttacagcagtgatcttagctcagataaggtcatgttttgtttttgtcttttgtcttcctgcttgttccagtcggtcccagtcttttgaagtgggactggctgggaggtcacaatgtccctattgtctaggatgacacttctgggcttaggtcatgtgtccagtgttcagaggaacccagagccaaaagaatcagacactagaactatcagtggcttaattgttctgcccttctctccagggctactgacaaggtaagtgtctgtgcttacagaggcctgtggtggcagaatagctgagccctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 183 - DNA, 2071 bp, Artificial Sequence
  CN2094
gcggccgcacgcgttcatgagactcccctgggggagaagagagagtcagagagtcagactgtcatgcccagagagtggctggctcctacccccggaaatgggcctcttactgtgactgccctggggccagccgaacagctgcgttggccgagcaggaagtggtgaacaggctggaccctgttccagcacgttgtgggggaaagaaagaaaaaagaaaaaaaaagttccatcagagaaactgcacgctagcttaggccaaggctgatcactgacctcctgtgtggtacaatcgatctggaccaaccacttcccccttattcttccccgtatgggaaagtcggtgcaggtgcgcagggccacacaaagcagcttgggagatagcagcccaggaaaaataattccacctgtaaacacctgtgttaacaagtgctgtatttgttcagctattttctttttcaaacactgtttacacacacctattctcttacctcggtcaggtgtgtcttgcatggcatctggggacccactggcaggagtccagggtgcctcagaaatgcctgtgtcctctgcccagcaatgtagggctgggactgccaggctctcagctggagtgccagtgctgctgggtcagcctcttggaatgctttcaggtccctaggtgcttaaggttgggagacttcacgtgaccagaagggcctgtccgggggacagtgaccccagctggatggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 184 - DNA, 1721 bp, Artificial Sequence
  CN2095
gcggccgcacgcgtgctgccccttggggtcttttaagctactgaaaactctgtggagacagcaagtcaaaggcctcctacagacgggaagcagaagtgatgctgaagggagccatgggggcacctgggactgttcaatgccgaaagtgactggattgaaagaagcaccagaaagacagggaagacctgaagtcacctccctgtcctctctagacaccggaatcttcagctaagagaagtgaatgtatgagacaccttctcttcctcatgggtctgaagagatattgagaggacggaagctagacacagtctgcaggagggacagatggattcaaaggggcaggtctcggaggctacgtgacaaggtctggtgcctgggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 185 - DNA, 1842 bp, Artificial Sequence
  CN2096
gcggccgcacgcgtaaagcctcgggtctctgtcccacctagagatttcggtctctagaaatggcagccacctgctcacaccccaggcacccttactccaccccgagattctgacatcaccttctgctgtgaccaatgaatggagtcccagcaatgatgaggatgtgaatgccagctacctcccccacccgaggcctgtggttgcaaagatgctctaacaggaagcgggtttgaggagctgcacagcttcctgctccccctcgagctgcacaggacgagaagggctagcgctcagcttggccacgagacacagcttcatgccagggttctggtagcttcctcttccatatctacttccgtgtggccccaggggccccccagaggcaagcgctgctgtcccttgcccaggccaccctccacctccagtttggagccctgccccccctggggctgggccaagcccaactactgactgggattccatgggggactggtaggtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 186 - DNA, 1703 bp, Artificial Sequence
  CN2097
gcggccgcacgcgtagggaaggcagcagtcttggcaccaccaggagactatgcagacaagagctggggttcaggccaacgaggaatcaaggacttaagagaccaaggtcgtttaaaataaagaggcacagagaaggaagcctggcattctctggtaatgcaccttaggcatgggccaattcttcattgagcaatgtcagaggttaagaagctcagtaaactgcagctgaacagagaagtgagatctggcaatctcacaacactgagtaaacagaaatcggaattcagggctgccaaggagaaagaggtcatttgtaaacactccagcctttttagtttgtctgggtccttggcaaagctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 187 - DNA, 1650 bp, Artificial Sequence
  CN2098
gcggccgcacgcgtgatgggtgggaccaggaagggactgggcaggagctcattttgggataggggaggggacagctgaggggttacagatggagtaaagcaaagcccaggcatcctatgggaggtctggctaaaagccagggtcctacttgcccccacgctccacccaactcaatccctgccccttagacctcctcccaccagggggctggctacaccccagtaagttttaacaaggcacccctccccttggcaggactcacagggaaggttttgtcttgctcagcccagtttctccagcgcctctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 188 - DNA, 1678 bp, Artificial Sequence
  CN2099
gcggccgcacgcgttccatggcttccacagtcactctgcctagttctctccccaccactcagttggtaccactgggccccaaggcagcaagagagtcaatggctccttttctctgtgagtgtgatggatctggggtgggggaggagatgtccaatagctgtctttgcagcagccatagacacaatgtacaaagcccatcttgttctttagcctgagcttcaggtccaacaatatacactatggggacaggagagcaatccccagctacagctatctatctgcagggatgcttgacattctgctctgggtaacagggctagggttgttcagctgagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 189 - DNA, 1600 bp, Artificial Sequence
  CN2100
gcggccgcacgcgtcagggctgtctcagttgcctaggaacacttagttaatagtgattccttccagggcgcttcagttcactgctgacctcactgatgatgagtagttgaacaaataagggaaagaacactagagacgtttttggcttctctttcactgaaagcatggaagaggccaagaagtttttgcccacggagtaggaaagaaagtaggacatggaaacatcttttatcaagcttcttacaattgagccttcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 190 - DNA, 1837 bp, Artificial Sequence
  CN2101
gcggccgcacgcgtttagcgggcaaaggacgtttatttgatgaggggtaggagcttggtcaattctgtgatccctagattagattgttgggcagacacacccacttttcagagaggccattggctcctgtgtgaaagatactcccacagcaaatgggggagggctggcagcctcatttggctttctgccatctctcagagctgggtcctggtgtgctttggggaagcgtctctggcagatccctgctagctagtgtttcctgacatttgtttcagagaccttaataaggttactggaaaaaaaattttctctcttaaaataggttcactaagctctgggttctgccaggcaagtaagtctttcactgggtcttggatctgcagggggcttcagaccccttccagaggaggggttgcctctgcagaggtctactgagcagaaagggacaagatgggaaccttctttgtgaagctcacttggtttcagcacctgcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 191 - DNA, 1850 bp, Artificial Sequence
  CN2102
gcggccgcacgcgttggctctggcaaaggatggagattttttttttaacctattcttttgagaataaggagggtctttgtttctcttccctgggaaccgagcagcccctttctctgagggtagagttggggcatggctcagcagaacgacagtcatcctggctagtaagactcagaggctggccttcaaaggcttgagctcctgggtgactgagcagtggagaaacagaatcctgcccttgaattgctccccaggcgggctttatgcagtctggggaagcaagggatgccctgtgattcttaaagaaactggtataattttgcactgcatagcagactcccaagacacacagccttttccaggaggagttccttagaggggaaggggataggttgcaatggtctgcttagcctcccgaaggctgcagaagctgctaagacaggggtaactgaaagatagactctgtgaggttgaacagcaatctttatgacctgaccccctaggcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 192 - DNA, 1792 bp, Artificial Sequence
  CN2103
gcggccgcacgcgtactggtgagtgagttgtgcagtttgcaaaacttggaggtctccctggaaacagaataaaatgctgcagtgtgatgtccagagggagggggcttttatcccacctcataattaaatctgaaaggttcctggggcgagctaagaggtttctaatgaagtactaagctgtgcttggagtctgcaccacgaaaggcgctttgttctcctttcaaaaggttccagtgctgaataatttggctcccagcgctggctagtttcagaccacctgcagattctaatctacgcaaatttatttggtacaaactttcttctacgtcacttggttcagcataattccagagaggtttattgctaatgtttaacagccatcagagaacagctgctctcctggggcctgcccctcgaaagggaaaaaggggggaaatggggcttttgtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 193 - DNA, 1953 bp, Artificial Sequence
  CN2104
gcggccgcacgcgttccagaaactgagtctgcagcttcttagcagttacttgagaaaagaagtagaagaactgatttgcttttacaggcttctcagcagaatctccgtggattactgtgctgggcttttagtagcacaacacgtcagtatgtcagtgcttactcaatgctattttcggttctccaagtaaaatcatgaacactgagccttttgttcaaagtaccataagggcattctgatgtccgttcttagtctgaggttaaaatggagacagctaaacaagttgtaagatccaactttctctctctctctctctctctctctctctctctctctctctctctctcaatctctctctctctctctctctctctctctctctctctctctctctctctctctttctctctttttctccctcccttcccttcttatttttcgtgttttgtatttttttcctaacaacaaacaaaaggaagtactcacttgaggtgaggacaaggctacttatgtaagagttgtgcaagtggagaggacatgccccctgcttggagattagtccagcaaacaaatgatcaatttaaagcagggacaaaagttactgaaagggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 194 - DNA, 1639 bp, Artificial Sequence
  CN2105
gcggccgcacgcgttcctccctgtcagtgacatcacttgaaaagcccaacaatgcccgcacacgcttggatttcacgtctagaatagtatctgtgtagccgacctcctggagatacctgcacaaaacggatccttatagttcagtcacacaggaattagtgttgtaaaatttaaaatgtaaataaaaatatttctttaagctcactgactatataaggtttaagagaacagtgccatgtcagtaaggcttgttaataatattccagctgcagatggagctgtctcttgcagtaccgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 195 - DNA, 1776 bp, Artificial Sequence
  CN2106
gcggccgcacgcgttggtgcgacagaaatatggctaaagctagttttgttttaaatagaacatggatttctatgaaagaattatattgataaattattagtagcaagttaagataaattgttaacatttgtctactttatgcactaggcacaaatacttattaatgaaacccctcatgtgtgaagattatttatttatgtttctcaaacaaaaatggtattgtatccgattcactgggtgtgctttgtccagtctgattttctcattagcaattctctgcatgattaaatgctaaatacacagctgtgtaaagcctcaactggtagtaaccagtagtgcctaatactgctgtcttaaaggaataacaatatagtcaaatactggatgtacaagctttaaggccccattcagctgaaagacctggggttatcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 196 - DNA, 1719 bp, Artificial Sequence
  CN2107
gcggccgcacgcgttcctctgtgcaaccctctgctctgtctggtgtgatacacagaggttctacacaactgggctatgatgggacaaaacaaggctccactcatagcaactgcctgcccgctctgtgcataaagaaagggttctctgtgttgtagcattcttgcctgtcagctgctcaacaaacagatgttcatgttctgctcagagttctggctaccccaggtccaggcaaggcacagagtagtggggataactgcagaggaagggagaaggggtgagttgggcttcccatactgcacacttttccttcccctgatgctgtttgagagtgagcctcacagtttcacctccagcagcccagtgcagccaagtttagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 197 - DNA, 1678 bp, Artificial Sequence
  CN2108
gcggccgcacgcgtgggagtcccaaatgtattcaatcctgacacttaaagagaaatgtggcttcgtttctaaagagccattctcaatcctatagagctgctttctagtagatggaatacacaagcatctgcctgtgtctggtagaagcctagaaagtagacaatggttctattcaggccaagcacttcccctccaacaggcatctaagcagcactgtgttagggagatgactctgacatgccctgaatagatgaccggtttggagcacctgccctgtggactgtgacagcacaagccagggatactgaatcttctggcctatgtctactgctctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 198 - DNA, 1653 bp, Artificial Sequence
  CN2109
gcggccgcacgcgtgcactccagatagaaaggcccattgttttctgcatctgaagttaacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcaaaaatcaacaaataaagctttatctttccaatcctggactcacccactgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 199 - DNA, 1707 bp, Artificial Sequence
  CN2110
gcggccgcacgcgtggactgagagccccagttcctagacgccccccagccacaaaacggggggcccggttggagtggagtttctaagaataaagccacttccagagcgggcagagatcagggactttcaggccagctccatccaagggtgagctcaggcaggcccggctggccgggatgggaagggctgaccacttcctgctcagggctggcggtcccccgcagtcatcagaagccaaccacttcccggtctgggccgccttcccctttctagccaagcgggagggtagaggatgaggtggccctttgcgtgctgtggcctgggcgactctggcctcttttcatttccccactatcgctgcgtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 200 - DNA, 1658 bp, Artificial Sequence
  CN2111
  misc_feature (36)..(36): n is a, c, g, or t
  misc_feature (39)..(39): n is a, c, g, or t
gcggccgcacgcgtactgagaaaaatgattgggccnctntttttttttttttttttttacagagagctaatcttgaaatcagaatctgtaggtagtggaccttcaatgatcactgtttcaaatcgagatgtgactttaaaaaaaaaaaaaaaaaaaaaaggaattccagacagctgactgtggccaacagcagctgtgtcacatgctggtctgaggaagtggtcagagggcaagcaactctatattgcattttctttgcagaatggagccctctgcagctgagtgaacccaggggctggacgtgctcaccctatgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 201 - DNA, 1728 bp, Artificial Sequence
  CN2112
gcggccgcacgcgtagctctctgtcctagcacagtgcatgacaacaaacaggcaaagaagatgttgaaaaagatgcacacagaatggatgaaagtttgcaaagctctctctctccctccgagtttttctttttttctttttccaagatcttccagaaaaaaaaagcagaacctttgaccagacagagcaaacatgtcacagagttctgctttcaccgtatgttaagtggaaatgattgggcaagtgagttgtaagcgattcctctccgagtttcctctgagctgggggttgatcctgcgcactcagactgacagtgcaaagtgtgaaggcttgcgctcagcactctcaagtcccaccgtgcctcagctaccttccatcgtgggcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 202 - DNA, 1842 bp, Artificial Sequence
  CN2113
gcggccgcacgcgtcaggaacctggtgacatgggaaccagggcccaaaagatatggggtggggcagttccctaaccagtctgtcacgctagcctttccactggcagccgggcctggtttgtagttccatccagcacttgtccaggcccacaggctggggcctcccctccctccccaaagccccctccccagggcctgtttcccggaggagctggggtcttccccagaatccatgattcactcaagctggggccttttcacttctgctttggagctaaaaatatagagaccaaggagtcttgttgagcaggcctccccacacattgcacaatatcccccctcggcccctccccagaacagctagagagctctgctgacgcagggtccaatgtggacccaaacttctcctaggttgtctgtgctgaggtcagggcttacgttcacgcgctgcttttgtgagccagaaagtcccttcctgtagccctagtaacccaggcatgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 203 - DNA, 1773 bp, Artificial Sequence
  CN2114
gcggccgcacgcgtagcccagactttgccttcctcccaggatccccgaggcctcacccttcctgtgcgaacttgcagacttccctaactgccactagggaccacaactgcctgactcacaaccaacaggaagcaggctgtgaggggccaggtgaaatgaagtcaaagacacaggaaatgctctgagccagatttctatcattgccccaggtgatgtcctttgcctgagttagctaactatacaacccagcatcctccccaggtcgaggcagagctcagataccatctgtcccaatctctcacccaaataataaattctgaaggaaacattcctgcagctcagccaggcaacttctgcctgtttgtagaagcccttgagaaacatgtggacagactcactcctctcttgtgcaagctacactgccttggggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 204 - DNA, 1735 bp, Artificial Sequence
  CN2115
gcggccgcacgcgtacagggtcccacaagccaaactgaccattctcatcagcgcagaagaactaacatgtgaccaccatgggaggtaccccatctctaataccagttaatcagagtagaaacatttttcaccttggccattaaggcagatattttgatcattctgttcttagtcacaaacctcattacatttacagtaatagaagaagaaaagagagaaccaagggaaagccctactcttctatcaggtttccccgtaaacgtcacttctctcaggaagccagtcagacagatctaccccaaccgacttcccctggctcagctcttctcactcattacattatcccttccagaatgatctttaccctctagtccccaacacattccccagcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 205 - DNA, 1655 bp, Artificial Sequence
  CN2116
gcggccgcacgcgtacctggatcccccgtgtttctgtggcctggcctcctggttctggggctgggcagggaggtagggaggacctgcccattgttcccatgtgccaggtgagtcaacgccatgttcccagctgcacccactccattcctctaccctgaccttaggaaaggaagaccaagcagtcttgtaaaacatttgctcaatccctcagccacagagcttactacacaactgcctgcgtggcttctttggccataacgcttctgtgccacctttagctctgcattgcagcccagtgcacacagctcagtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 206 - DNA, 1571 bp, Artificial Sequence
  CN2117
gcggccgcacgcgtggtgtgctcttggactccctctcacgtaactttttttttatcaatgactagtattagaaaaaaaagattcattgacacagtaactgaaagctgactgggaaatgagaactaagaagaggaagtcatatccacagtggctaggttagagccacaatcaaattagagaagcaagtcttctgggcaggcgaaaacaaatgaggggaggacgggtctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 207 - DNA, 1883 bp, Artificial Sequence
  CN2118
gcggccgcacgcgtggagagtgacctgactacaccagaacacatgagtgacatgctgaggattttgttccctgataactggcctggtctgtacatggaccatctcgggctattttatctgagatcattggaatactctctcctcttgccatgactaatgcttttctatctctgaaatatgacttcctttttgttgattcatgtaataaacctcagagtgccttgcagggtgtatctagtgtgtcattacacagaactggaacattctctgatgtgactagattaacagtactaacgtggtaatcactggaggtcagacatcctggggagcaggctggcctctgtgggtgtggttagcactcgtgattctggggactcaggagttagaggaagtaccattttaaccgaggagctaaagctatccctacacagagctgtccttggatttcccctgccaagtactcatgttttcaggtcttaccctcaactgtgtcctgctgctgctgcaactactacttgcaagtaagtctgggcctgggcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 208 - DNA, 1673 bp, Artificial Sequence
  CN2119
gcggccgcacgcgtttgaacttgcagggggctcattaggtgtccagagacttttgctgatggatagcatgcactgggcatgagcctgctggctttgacattttcaaactgcacacttcctacagcgacagcgtgccaaagccatgggcctcactgccatcttctcaaaaccaggaaatgaaactggccactaagagcaagtgaccacgagccagggcattggtgcaaaccaagcaaaacacgctgtcggcagcctaggtcacaaggaggaacgcatctcatttgcagcaatctttgaagaaatggtccactcctgctcctcatcctggcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 209 - DNA, 1867 bp, Artificial Sequence
  CN2120
gcggccgcacgcgttgacacttgcaagcagttcacttattatggaaaagcatggcttcagtggccaccagcgcagtgggaggagacctgaagaacacaaaacaattccgtcctctgtatcttcagtagagctggctccagaagagggtccagttctgaaacatggaacattctccccattgggctctctgggaaaaggcctcagtattgtagagggtgcctctagctattcaggtcttgccaaggagaacggccaagaaagacaagaggtcacatggccaggcctgcagccggcacaaaatgttctgagcaactaactgatggctggacagggaccaggactgaccctgaccctacgttgagttttctaagagaggtaggccaacacatgatgcaaaggattctattgttgcttctgcaaagcaagatttgagttaacatgagttgtatgtctcttctaaatgaagagacatgaattttttttctcatatgtacttttttaaacattgcaataacccagttacgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 210 - DNA, 1861 bp, Artificial Sequence
  CN2121
gcggccgcacgcgtggctgagccctgtactgaccaagcaacctgcagagggtgggggcgactgagggagcctggctttgggggtcagctttgtcctgttagatggagggacggacaccagaggtttggggactttccttcgtctcacttctacctgaggggtgggggaaggtagaaaggctagaatgctggttggcagggcttgagttcaggcagtcctgggaaccttgcctgaagtgcctgagacagaacagccatgaaggctggcctgaccaggctagccaaggggcaggagcagggcatttttcattcatattcctgcctctgcatggcagcccacattgccacccctgttcctgggctcccagcctgatcccaggctctgcctgccccttggcagccaccacccagcctatccacccagatactttcgaattcccatgcttctaaccgctccctggcccctgtggggtaggtgtgctgaaagaggctcaggcacaatgtggatgtgtacatgtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 211 - DNA, 2012 bp, Artificial Sequence
  CN2122
gcggccgcacgcgtgccctcccgcttctttcttgtcttcaacaagaaattaatatctcaagataactccgatgtgttggtcccagccagaacacttgaaagacacgttcaattagggccacagcattgcttctggagtgaacggctatcacactgccctggagttcagtctcctctgcacacacataaacacaagtgcacagcgccccaatgctgttgtcccctcagccttccagcactgccagttggcaaacccaagccaggaagttgtcaattccaattgcgtttaggccatgtagtcctattaaagaaggcttgctggttaaggggcatcctctgtttccaaagcatgggaaaaaagaaaaaaaaaaaaaaaggctgtgcttagattggagctggcaacttccactgactagaattttcaaggggctgtgaatgagtttaacaaaggaggtctgtggctagtttctggctgaagtccatgtcaacagtttttaaggtcacaggccacactaactaacatttattcccagcagaccctgttctaaacacaagctgtacatagtacaaatttgaaatttttctgtaatcccttgagatattcctgatccctccacatgtttctgctcaattaaaaacaattctcacttctcaccacaagagaggccagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 212 - DNA, 1804 bp, Artificial Sequence
  CN2123
gcggccgcacgcgtaagccgctttgaatgctgcatgaaacagctaaattcgttctgctcttgaatgagttcccttagcgggcaatagttttctgaggctttgaaatgatcactaatactcgagtgagtcttacagcacttctggagtggaccagagcacttctcaatacaaaccagcagatgaggtcatggtcatgcaagtcgtcgggggggggggggtggcagcaacaatcattgtcaaaggggtgttttctgtagatgagagaatgaaactattgtacaaaactcaatgggcgccaagcatgtggcccaattatttcgcctgtatgagcatggcacggaaggctctccttagagaactcaattcacacatttgtgttttgtcttgtattcatgggcaaaagcctagagactttcaacctaagaggcttcaccaagttcctgtcttttaaacctagaacgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 213 - DNA, 1673 bp, Artificial Sequence
  CN2124
gcggccgcacgcgttacggcctgggaatgcagagtgacagggttgataatctgcatggctcttccccactcaagtgctcagtggtcaacagcaacaggacaacacgggcttatgtcctgaggaaggcagctgctggggacaggggtggaacagaggcagctgggggtggagaggagcctgttaccagctgcacaatggatttctcagctaccagcaacccctctgggtgacacctagctattacagttctcatagccagctctcctcatagggcaagaagaaagtatggctccagggagtggcccctgcacacgctaatgctatgccctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 214 - DNA, 1751 bp, Artificial Sequence
  CN2125
gcggccgcacgcgtcttcaggcgctgggaagctacccagggagtcagagagccagagcaactaggactcaactctgtagagacaagctagcatctgatctagccctgttgccttgacaatggctcatatcccaggcaccctaggcacccacaggagcaattagtgagtgtgggagagggtttctatggtggcggtcccaaggacctagggaagaacaagggccagcaggacctttctcctttgtcctgagcacactaggcctttgttcttctctggctctctttgacagatgggagcaggaacatggttagggaggccaacatggtttaaagtcccccaccgatgggagccctgagccatctaggggaggctatgggaggttgaagtgcctctctgggactcagctggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 215 - DNA, 1687 bp, Artificial Sequence
  CN2126
gcggccgcacgcgtccacattctttgctctcacctcctgacctttcgaccaggaaagagagccaccagttgctggtgctccctcccacacctagttagctgggtcctggaggcatcttcccagcggggcatctctgagcttggtggctctgcactggcagtgggccctgctcagcaaagaaagaacaatatggactctgttctcaattagtgtgtaaccctcggggcaggcacaggctcactcctgctcccctgtactttaatggcctagtctgatgttcctacagctcggggccaggtggggcaagagcccagaaacaggagagcaccttgcattccctggagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 216 - DNA, 2030 bp, Artificial Sequence
  CN2127
gcggccgcacgcgttcggactttgcttaccgtgtcttctcatgctagattagctgttagtaacacacactagttgtctccaagaccagatggacaggaaaaccttgaattaccaccttcatgtaattccacgccagatatctcagcagacacatacacacacacaaacctcttattgctcccctgaaagggcatctgagagtagggctcctgaaaatgtgtgcagcctgtgataatggggcacacagtagacaaaagggcagaagaaaaatgaggctttaataggcacactatctaggtcatttatccttggataatgggaaaaaaacacaatgtcgtagtgtcagcaagggacacaaaggcattctggtgtcctgcagaccagagcttgatatcaagagccagtgtgtggaaaaacccacgtggaactaaaatggacccatttaagtgtgtgtgtgtgtgtgtgtgtgcgcacgcatgcgtgcacattcacgagcatgaactcacattcacccagtctcaaggactactagattattaaatcctttatttgttttctacaataaggtttaaattataagacctttttctatgtcatttcagcaaaccctatttccatctaagaaaggagtgatatacatggaattgtgcttgtcttttaccttcccataccccctttacacaccagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 217 - DNA, 1716 bp, Artificial Sequence
  CN2128
gcggccgcacgcgtatcttttgaaaaaggaagaaagaagcttttgggttctttaggaaccagactcagggcagtagtggctgtgattatcagagacacctccccgacccccaattctagagtcccctcctcccagagtggcattagcttctgtcccatgactactatctggcttcccctttctcttgcacccagggtgctacagggcgtgacatacagtggggggtgggcaggggggggaggtttcctgcatctggctcttgcctaagggctccaacctcaggttcctccttctccagttctcgatcaggctcccactggggactaaaatagtcccaacctcctctcccatgatctcccctctgtcctggctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 218 - DNA, 1760 bp, Artificial Sequence
  CN2129
gcggccgcacgcgtcagtgtccacctctgccacaagagtacagcttaagcctcagcagagccagtccgagcaattaaaggggcagggccctcacagccagagggtgggccggaaaggctgggagatagcagttctgaggaagcaaacccaccctctctctctttccacatcacgcggacctggctgacgtggcccaggaagaggggacaacccgggccctgtggttgaaattctatttatactgactgttgcaagcctttcctgctggcgacaaggacgtcactgggcactgacctcaccagaatcgctgacgcatcttccctcacgctttgcctggatggtagtgaggcaggcctctcatcctctgggccactcccactgtccctctgcgtacagtaccctccactcctgtccccgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 219 - DNA, 1977 bp, Artificial Sequence
  CN2130
gcggccgcacgcgtaaacgcatttgtgggagggggaggcacaaatatcccactgaggagagagtagtttcagggttccagaggttcaaaggggctccaaggagctccgaggggctgcagggcagaaagcagaactaaggaccggtccgtgaaggtcctcttcccaggaggaaactgtagccccacaatgcctagcctcacaggaaaccacgtgatggaaaaaacacaaaactccttctggggagagagtgagaagtgaggttgtgaggtttcttcagctcggggggtgggggggagagcattttccaaccgcaaggattggggggggggtggagtggggctcagtcctcttggtccttctcaactctgtccagaggacaccatagctcaaggccttcagaggttcctaccccaacccaggcctcctgggccatcctagcccacctcaggaacaggccagagaccccaagcaatgtgagggggctcagctccttccctcagggacaggatgaggaagtctccatgcaaatgtgaacagaccacaggcagagagttcactattgaggggacaaatgcaaatttcccagaagaggaggggcaaagagaggagccattgggtcatggcttccacacagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 220 - DNA, 1755 bp, Artificial Sequence
  CN2131
gcggccgcacgcgtagtgtggcagagtgtgtggcctgggggagagcagaaggcttggaggaagggatatgcagacacccagcagggcagggctggattatggactttgtgatgacagcagattgaaaagagagagctctggtgtcttgaaaagaggaactgctctatttgggtagcttcctgggtgtaagggaaaagcaatgtcaaaagttcaggcctggggcgccttccagacccaatgccactaacagggatagggcggggtggcaggaaggagacagacttgagcgtgctctgcctcagtggactatacaatctgtttccttcacacatgcacaaagactgatgggaaatcgagtgttcacacatagaacgccaccggcctaaccagccctgggagggcacacaggtcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 221 - DNA, 1664 bp, Artificial Sequence
  CN2132
gcggccgcacgcgttggcaagggtcagacagagctacaggttggaacacaccagctaccttcacacctgagccctagcatggctcacactgggggtgcaaggacactctcttcctcaacctcctgctggtaagctaagcctgcttcctcttctcttgctcacagccaagcagtccaaaccacaatggtgtcactgtcagctatgacatcacaaagtaccgtggtggaaaaagatgtgtgtaggtatcagagtggtaggtcccagagctgcagagcccctgtcctacataagaggtgggtcccaaaccccaaagcccctgcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 222 - DNA, 1712 bp, Artificial Sequence
  CN2133
gcggccgcacgcgttggagtggtcatgtcctctttttatataagtaaaaattattcttctcaacagataatttgcattgtttagggcttcagaatagggaagtagttatgctaaaatcagaagagtgaaagagccaagcaggctgagagcccccttgaaaccccccaccccatgctatgcctcctctgaggaagcagcagaaagcccagcaaaatttcaggttcctcctttggggaaaagagaagttgacctcagtagtttctcttgaaagttacttatgttgtgctgcagcttgcatcactctggatacaggatggagttctttcagtcttggagttctttcagtcttggagttctttctgttctctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 223 - DNA, 1751 bp, Artificial Sequence
  CN2134
gcggccgcacgcgtctggagccattggggaagggcaagcctgggagccaggaagccacctgcccagggcatgtgagatggcctcttcagtcccccccaccccgcccccctcccgccaatacccagccttgtcgctggtttcctgtcagtctgcactccccagggaggggaggggtggctaatctctgatgcgttgtggaggcgggctccaagaccgttgggcgccctgagatccgacccacgtggcctcggggttataagccctacccaccctgaagggaaccccactttggatccagctcttctcagctctgcagcatcaggtaagacctaaatcttcactctggcctcaaccagggctctttaattctgggcccaaggctcagagaagagcttggggtgcaggttgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 224 - DNA, 1650 bp, Artificial Sequence
  CN2141
gcggccgcacgcgtctccctgctccccaaccgcagcctgaggtgtgagaattctagatagggccacgacagtgtgagcacatgaaagattaccaggaagaggttgaaacctggctcctgggagagagaggggtgtgaggccttggcaggaagcccagtgcttggctgccctggtttcctggggcccaggcatgcgtggtcacagtccacagcctagggctgggccaggaggacatgcctgccagagtcccgagggtgaggggaaggaagggacaggaggcgctcagctggggcagggagaaaccaagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 225 - DNA, 1621 bp, Artificial Sequence
  CN2142
gcggccgcacgcgtgaactgaacatgatgtgagatgtgtaactttcatttattcactcatgtgccaggcaccatgctgacattacatgtgaaaagtttccaaggttttcttgttacgtctacaattactgctaagtttcccgtaagtaatttgggggactggaaacgagggcaaaattacatgaagggcttagaaaactgcatcaattctttttggatgtgtcagggagatgggggtagtctttctccctgctaatcaagacccactagagcaccgcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 226 - DNA, 1685 bp, Artificial Sequence
  CN2143
gcggccgcacgcgtggccacgttttgcctagggaagatgaagtctttgatgatagccaacttagtgtcaataagtggctttctttgagacatattcagatgggaacgtcttgcttgccaattgccatagaaatcttaacacaccatgaagattgtccgagcgccaagccttccgttctggactaaattactttgaagtggcgcagtacgagcagtggtcaattttaactctatagactggacagagaatgctgggagtgggagattgtgcgttttaaagcagaaaataagaaggggaaacttgttttatacactctatacaaggttctgctcattgtcagagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 227 - DNA, 1913 bp, Artificial Sequence
  CN2144
gcggccgcacgcgtggggccattgagattgctggatcctgattctttgaagcatttcattcattatggtaaagaagggtttaagtggccaccaacagagagacgtgaagtacatgaaacaattaggttctctgtatctccagcagaattggccccagaagagggtcaggctttgcaaagacacagaacatttttcccgctgggctccttgggaaaaggtctcagcattatggagggtgtctctggctattcacagcttgccagtgggaacagccaagaaggagaagaggtcacatggccaggcctgctgccggcacagaatgttctgtgcagctgatggctgggcagggatgaggtttgcccgatcccctgctgaggcttcctatgaaaggtaggcctgagagttgccaaaacatattctgcaacagggtctatgaaggtcaccataaagcaggattcagactccatattagttggttatctcttctatacagaatgttatgccaagcatttctatatatattccttttgtttgtttgtttttgtttttgttttgagagggagtcttgcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 228 - DNA, 1841 bp, Artificial Sequence
  CN2145
gcggccgcacgcgtgttatcacaaagcttctagtcaaccttaatttctaccacctgaaattcagaacctaaggctattttacaatctttacaaaatttaaattatttttctcttaaaagctgggcaggttggtgggttttcttggtttattcttcaggttttttgttttggtttggtttttggttttagtccttgagctttgtaaataagttttcctgcgcctgcttgcctgtaacttatttttctggtctaatgactgttttttaatgagttcagcctgtgctttcttgtacaaaaagaaacgtgggcatgtgaggagcatattaattagctatcagatgtagcctggtttttgaagtccagatcttcaggatgttaccgaagtgtaaatataagcatgacttttgcacgtgattagtaattacatcacagttaaagcctcaggggaccttccaccccagaattctgctatcctcaacccctgaatggctctgtcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 229 - DNA, 1590 bp, Artificial Sequence
  CN2146
gcggccgcacgcgtgggctttctaaactggcctggaacactgttagttaataaacattcctttcagggttgttctctttgcttctgatctcattgatgatgatttgttggacaaataaggaagtaaacagtgcagagttttttggcttctgctctattaaaaacatagcagagaaggacaagaagttcctgcctgctaaataggaagatctagggaatcaaaagagtctctgtcaagcttcttgtagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 230 - DNA, 1873 bp, Artificial Sequence
  CN2147
gcggccgcacgcgtctttgttttcatggcatattattgggcaaagatactatttattcgatgctatgtgtgagctgggtcaggattatgaccctgagttatgtttctgggaaaatgtacccacttgtcaaagatgccgttggctcctgtgattaaggtcagcccacaatgaatgtggggagggctggcagcctctcaaatcagctcttgaccatttctcaagctggggcctgttgtgcttgggggaagagtctttggcagctcagctcggggctagcgtttcctgacatttgtttcgctgaatgttaacaaggttactggaaaaaagggttctctcctaaaataggtttagggaagcactgggatatgcgaagtgaatgagtttctttagggcaggatcttgactctgcagggggcttggaggccttccctagagtggggcttcctaacactgcagagctcttcccaggacgaggggcaagattgggacctactttggaaggttgtttttgtttcggcacctgctctgtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 231 - DNA, 1730 bp, Artificial Sequence
  CN2148
gcggccgcacgcgtgagaagccaggcagacagctgccaaagggcaggggagccagcagagcttctgaaaatatcatgaggcttggaagacaaacactggagttcaggccaagaggaaatcaagggcttgggggaccaagatcatggaaaataaagaggcatggggaagtcagcctgacagtctctggtactctccattagacatttgccaattctttattgagcagtgtcaggggttaagaagctaagaaaaattagctgaaaaggagaagagagtttttggcagcctcacaacactgggtaaacaaaaactggaattcagcactgccaaggcaaagaggtcatagtaaacactctagtcttttagtcttggaccattggcaagctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 232 - DNA, 1799 bp, Artificial Sequence
  CN2149
gcggccgcacgcgtgacgcaaagcagagtagccaacaaaaaccacttaactaggcccacctatacagtatgaccaagttgaggataagcctcactaaaatatttcacctggcatgtgttcaagttttgaggttgaatgagtctgcttttgtttctcactaagcctggaagaaagggaacttgttagggaggaggagaggagagaagggaggaatgagttaagtccttagcatctttagtgctttttctttgcttcttttcaaacaagcacaccacattgaatagcatgtggaaaattggcatttccagtgaatagaaattaactggcaaacaacaaaagggaaaacagaggaatgctgctggatgctgtttgacttgtctcatcttgtcagagaaggaacacctgtgaatcaaatgatttaagatgaatttacctacatgtttggttcctgttcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 233 - DNA, 1878 bp, Artificial Sequence
  CN2150
gcggccgcacgcgtacgcttggactaagtcggttaggaataggaatggataaataatggggcaatacaaagatccctggtcaacttcacagtctgtcatctaggtgctccggtttttaacatcttctgcaaccttcgggaaacagaacagatcatcgcaatctactgttttttttttttttcctctaagaaaatgcccatggaaaagtgctggatgtcttgcaaatctgttatcgcaatgcaaaatcacaccgagtttctttaagaatcacagtgcattccctctctcccagaactaaataaagcctgccttgggaagcaattcaaaactggaattctgcttctacattgctcagttacccaggcagctgaagcctttgaacaggtctcagaaagtccctcaaatacagtctttttaggtcaaatgagaacagtcctgttaagtcatacactaattcctctctacaaacagaagtctggttaattctcagggagctaagaaaaaaaacaaagatcctctttcttccagaaaaatgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 234 - DNA, 1745 bp, Artificial Sequence
  CN2151
gcggccgcacgcgtacttggagatgtcccaggaaacagaataaaatgtttcaatatggtatcctaggaaaagaaggtttttatcccaccttataattaaatctgaaagattcctacagtgaactaagaggtttctaatgaagtactaagctgcatttagaattggagcaatgaaaggctctttgttctcctttcaaaaggttccagtacagaacaatttggctcccaatacaggcatgttttagaccacctgcaggctctaatctacgcaaatttatttggtacaaactttcttctacgtcaccttcttattcagtataattccagagaggtttattgctaacatttaacagtattaataagagaacagttgctctcatggggactgccctggaaggaaaagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 235 - DNA, 2091 bp, Artificial Sequence
  CN2152
gcggccgcacgcgtggctcagggctccatgacatgtggcgacatgcatgagcagggaggctcatgccaccatggaagcaggtgaccctggtggccctgccaggacccagccccaaaccccttcctgggcctttggctcccagggtctcctcaatgcagcagggcagagcctgggaattggacgcagcacagcccggctcagagccagcaaagttcacactgttctttggggagaaaggcgctcagaagagatgcctgggccctttgtcctgtagcttggtaacacaaaattctcacacttgtcaaaaaaaaaagggggctatccaacacccccgcccttcctcccgggccccctacccccatgcagtgactagagctgtggtcaaggactcttcttccccaaggcagaggaggcacagtgggctgccagattgccaacccggccaggacaaaaggcctttgacagctccctgctgcggttcagcagtgacccagaggctggccctgagaggacacggctctgcccagtccctggagagtccccaggtctgctagtgaagccctgcggccctcaagccaggatgactctttccctcttggctgcaaccaaatttccaagggcctgcatgtgcgcccatctgtctactgtccaccgcagaggtgaaacgggaacatgaccccacccgcccctctgcaccctgaggtcacatccgaccagcacagtcgtgcctcaccctgcacctgagacgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 236 - DNA, 2049 bp, Artificial Sequence
  CN2153
gcggccgcacgcgtccccaagcaaggtcaacagcagcttcaattacaagacaaacttaacaagagttgctataaaccaagtactctgtattgacttaagaacaggctccactccacatattgccactagcaggattgtacaggaatgcatattgtaaaataaaggaaggggtgagcttttttctttgccagaatttgcgagtgcacagcgactcctcattcacctctctccaaccagctagccgctcagctcaattcaccccacacaaaggctggagcctagacctcaatggaccgagtgaaacatgttcaaaactaggctctctattgtgactgaatttcttaacatcttttcaaaaagcggagaatgccttgaggctaaaggaagaaacaggctaatggtgaattgggaattctgagcaaatttcagagccctttcctcctagcttttgaggttgaaagcaagctctttcctttcaagtttcaaagtcctttttcctcccgcagtgtcacagaaggatttgaaaagaaggtaattgtgctcgcagtctccctgatcagagcttacgtcctatttctggtatttcggaatacttcttgcaataatagtgcatatagctcaatcccttaaccggcctgcactctgcaattgctcattaaatgaacaattgcgggtataaaatgccttttatgttcaaggtctggagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 237 - DNA, 1861 bp, Artificial Sequence
  CN2154
gcggccgcacgcgtattcatgaattatccaaagaactgggaaattttttggttgggaggtaaatcagttacatgagcataccgctggcaaaggagtatgccatatgactgatctctgttggggggcttctgtctgttgacagagaagcagaaaaacaaaggacaaaggaaaccctcattaattaatcttaccaactaagccaaataaatggaccacttgtttcagcaacagaagcaaactgttgacaattgagaaaagccacctgcaggtgcttttgaacacaagctgccccagagacccaaaatactattgtctaacacaggggtcagcaaactttctctgttaagagccagatagtaaatatttttggctttgcaggccatatggtctctgttacaactactcaactctgctgctgtagcctgaaagtggtcaaagacaatatcttataaattaatatgtagggttatgttccaataaactttatttatggacactgaaactgaatttcttttcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 238 - DNA, 1913 bp, Artificial Sequence
  CN2155
gcggccgcacgcggacttttatgcccagcccgagctctgaggcatagacacacagtggaaaatcatttctcttttcagtaagttttgggtctgctttaaattgatcatttgtttcatcagctaatccccaaacagagggcacgtccgctctacttgcaaaattcttgtatgtaagttgaattctccctttatcaactcaggccaataagtactttattttgtttttgcttgttgttagggaaaaaaaaaaaaaacaaagataatcagctcatactacttgcgtagctgtctgcattttaattccagactatgaacgagcgtcagagtgcccttatgatattttgcacaaaaggctcagtgtttatgactctactcagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgtacgcgtgcggccgcaggaacgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 239 - DNA, 1869 bp, Artificial Sequence
  CN2156
  misc_feature (33)..(33): n is a, c, g, or t
gcggccgcacgcgtagttcagctctttaatttnccattggctctaaccaagacagaagactttacttaagcaattggtttgaaattagatggacaagctgaaacaatgggctctctgttctttcctctctgtgcccaccaactggcattcattatttaatctgtgacgtgtgttgccagggctgcggtaatgacaacggcacctattgtcttcacatcccttccctattctgtaacatctgtcatggctcctgtctatatttcattttattttgttttattttgcttcttttacttttacaaggttattcttaattactacaaattgctctgaaatctattctaaccctgcaaagtgtagcatcattttgtaacttggcaataacaataaactgaaggcgcgtgtgatagcacccttttaaattactgtaattttacataaaactgtataatttcaaacaaattttatctcaaggttaactagataacctctctttttaaatacctgatcagttcacagacgactgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 240 - DNA, 1982 bp, Artificial Sequence
  CN2157
gcggccgcacgcgtctggccttggtctctcctgggctagaacaggccccttgtctgcctccctgaatcactcttgaggctgggcatgcaccttcccccactccagatgtgctgacagcagaaatgccaacccctcccttgagggccagtgaattcagcagtgacaggtcactctctgagcgagactggttctcccttcatccgcttgtaaagggaaaaacagcctcggcctctgagcctggcaccaccaggtttggccagtcttggttgtttgcctaagtcccagtgccttcagttcccatccctcttctctgacccccaactcctgagccccttgcctgtcaccctcccccaccccagctgctgcatgtgccaaccccccacccaggagaaaacgaggctcttggaagggaataaatggaggctctgtgcaggcttgcagctgaaatggccctgtgcgcggccacagatgggcctcctctccccctccacatttctgcatcaacaaagcgtgaccttgtttggatgacagtcgccccatgttttccccatgacaatgcttgccttgcctttgcctcccagcgggctgtctcaggacatctctgttccctgaaattgggaaagggtggtggggtggaagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 241 - DNA, 1698 bp, Artificial Sequence
  CN2158
gcggccgcacgcgtgtctgctttcaggctgctcagcaaaacatccctagactcaccacccagaacagagtgtaaagtgggcttgcagatagatgaagggaaccattggtgaggcttgctctcctatctattgctcatattcctagatcttgagctcaggccctgtgaagaacaagcctgggctttgtgcattgtgcctgctgctgctgctgctgcagggacagctagtgggcatctcttccgccctctggctccgtcaagctccccgagaaaaggaaccattgactcttactgccttggaacctagtggtaccatccgagtggtagagaaagtgccaggcagggtgaatgtggagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 242 - DNA, 1782 bp, Artificial Sequence
  CN2159
gcggccgcacgcgtggagatttggtcctgattttgaatggtttttcttggtgggcagtggttgtctgaggctttgaactgatctttaacacacaggaatgagttctaggcacttctggagtggtccagagcacctctaaatacgaagcagcagatgaggtcatggtaattcggggagtcagaagtggaagggtggggggttgaaagctataatcactgtcaaaggggtgttttctgtagacaagtgaatggagctattgtacacaaactcagtggttgccaagcatgtggcccaattattttgccttcatgagcatggcacggaaggatctctttagagaacttgattcacacaagtttgtgtttagtctaacggtagcaggcaaaagcctggggaatttgaacctaagagtctttacaagttcctgcctcccaaatcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 243 - DNA, 1858 bp, Artificial Sequence
  CN2160
gcggccgcacgcgtgctccggcctctctattcccactgctccatccaggaaaaccacgcccagcatggcaaagcaaacccttcctggggtccccctcactggggacacatctgggcaagccaaggacactcagaactcagcctggccaggctcggtccccacccccgctctggcccttctccctacagtgaaagggactttatggggacaaaaagccacccattgtatcacacgagacaaaggggcaggggacagaggctccgggcgcctaagctggccacgacacagccacacaccaccccctgactgtgtgagagggagggcaccttggaattcccatgccatgcattccagcattcgaggatcctggagtcatccccgctctccaggaaggcgacagcagactcggaacccagccccagatccactagacctgggcagtactgaatagccctaagctctcttttctcgtcggaaaaatgggcatgtaagttgccaaacggagtcattcagtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 244 - DNA, 1640 bp, Artificial Sequence
  CN2161
gcggccgcacgcgttccctgtccgtgacatcacttgaaaagcccaacaaagctcgcactcgtttagatttcacatctagaatagtatctgtataacccacctcctgtagatacctgtgtgaagagaatccttagagttcagtcatactggaatcagtattctataatttaatatgtaaataaaagtatttatttaaactcattgcctgcataagacttaacagtacagtactatgctagtaagacttgttaataaataatcttccagctgcagatggagctgtctcttgcagtaccgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 245 - DNA, 1776 bp, Artificial Sequence
  CN2162
gcggccgcacgcgtgtgcttatgttgattacttctttcagctgaatagggaataaggcctcaaaaggtttatatccagtatttgagtacttttgttattctctttaaaaagtcagtattaggcactactggttactaccagctgaagccttacacagctgtgtatttagcatttaatcatgctaagaattgctaattagaaaatcaaaccggacaaagcatacccagtggagttgatacaataccatttctgtttgagaaccataaataaataatctttacgcattagtgtttcattataagcatttgtgctgaatgtggcaatatttaacaaaatgttttaactcactagaaataatttcttgatattatcctttcacagaaatccgtaatctctttaaaatatagccagccttatcaaaattaagtttcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 246 - DNA, 1743 bp, Artificial Sequence
  CN2163
gcggccgcacgcgtggcagctcagcagtgggttagctggggcctgcacacagtaggtgctcagtaagtgcttgctgagtgttactggtgttttgttcattctttctcttcatcctgccccaccctgccctggctgctctttgctcattgtatgatccttttcatgagagagtgttttgaagagcgcagacagaatcttaacaaatagcgcattgtcccagcgatccaaagcaggactgcagtgccggggtggcccaaggctgcggggaagaggctggagagagcaaggcctgccggacagtggcagatctctaaggaaattgtcccctgggggttgtggttcttcccatcagaatcaggccttttgttctcaggaatgaggtgggctaagagagagttggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 247 - DNA, 1762 bp, Artificial Sequence
  CN2164
gcggccgcacgcgtgaagacagacagctgaggtaggatacaaaagagctattgatggcttttgtctatgtcagacagaagcctaagggaagggtgactgctctcgcctggtgtcatggatgtcacatgatagaaagttttatgtttgtttctgacattaggcaaacaaaaaccttttgagggctgaattaggcttttgttttgagcctgcaagctgctactcattcctattgatgagtactgatctgatttcagccttttcatttttatggtgttaactgtgtggggaatgtgtgtagaaggccggacacaggaccaccgaccccatctcccttgagttcacatatcttttggaatttcctttttttttcttttctttttttgtttcgtttcaggaggggggctgtctcaggagcttcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 248 - DNA, 1750 bp, Artificial Sequence
  CN2165
gcggccgcacgcgtttggtgttgtcctctggcccagccctgcccaggaacaggagacagacggccacacagagccttgcctctgataactggggggtggagaggttgagaaacaacgcttcactcagcaacttcctgctccctccgaggaagaagaaaggggtgtctgtgctagagccactcccttgccagcagcccagcagaacagctgctgatcccctgcatccccacgtcccggcggaggccctgggaagtgggaacatcagctggagagaaaaggagaaagcagtacattgagtgttgcttaggccgcctgcttcgctttcttctctcgctctccccagagacaatctcgtggcctgtgtttccccgcaggcaggccccagcgccctcaagcccagatgtctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 249 - DNA, 1712 bp, Artificial Sequence
  CN2166
gcggccgcacgcgtacctggaccaaatctgctgattcagtgctctgggctctctccacttcatcaccctcattggcaagtagtcgactgggcgggttgttcaaagcgtgccctcctcagcttctagaccctcccattcatgccatgtccagatgacatctccctgaacacaatgctccctctcagacacatttggatggaattatgcctggcctgaatgggaaccttgtctgctttctaggtttctcccagacaggggtaatgtttctagagtccatttactaggagcagcatgatgggactggggatgtccctttaaaaattaaaagttaagtttctctttaagtgccaggattgagtggatttggggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 250 - DNA, 1622 bp, Artificial Sequence
  CN2167
gcggccgcacgcgttactgctttgctccccagcccaggtgtcaccacccagtcaatcagaaagtcaaagagtctgagggcagtggagggaggttgtgcctggcccagagggttttaagtgtgaactggattgagaacaacatgccgattgttctttgtttgctgagactggcttggtgccagcgcagaactggctggccctgagaagcttacagagcctagtgaccaggtgtggggaaccagcactggctgcgggggtgggggtagaagggagcacaggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 251 - DNA, 1962 bp, Artificial Sequence
  CN2168
gcggccgcacgcgtagcttttggtaagacactaaactgtctcgaagactagacaggaaggaaaaccttgaattactctcacataattccactccagatatctcaacagcaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagggtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacaccctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 252 - DNA, 1747 bp, Artificial Sequence
  CN2169
gcggccgcacgcgtgagacggggacttctagcccccagctggagcctggggctggggaaggaggaacctgaggttagggtgctggaggatgagacagctgcaggaagcccccctcccccatccacacgtcacacccaccgctccttgggcctgggcttaggagaaaaaaggggaaactggattctggtcacagggcagatgcccagtggcctgtgggggaagggaggagaggagatttggagcctggaggagggtcaggtcccagctcagcccacggtcaccactgttcaggcctggctgagtcccctcccttaaaaacccaagcctctcccattgtgtctagagcgagcatggagggaacagaccctgtaggtcctcccgggcacaccaggccacccaatgtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 253 - DNA, 1798 bp, Artificial Sequence
  CN2170
gcggccgcacgcgtgaaggcatagctggagggcacaggggctggggccactgtcggagcatccagagtgaagtgatacacaggaggacagggagtggctcggaggtgaggaggcctggccgctgaccatcccagccaagcgtgaggaaagatgcgtcagcgtttctggtgaggtcagcaatcagtgacgtccctctcaccagcaggaaaagcttgcaacatggcccagccagtataaataggctccccgaccacaggacccgggctgtcccctcttcccgggccacgtcagccaggcccgcgtgatttggagaggaagagaggaccagcttggttcctcagaactgctgcttcctcgctttccggcttaccctctgctgtggggccctacgcctttaaatgcaaggataggacctgagatggcctggcagggccaggtcgaaactggaggctgggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 254 - DNA, 2050 bp, Artificial Sequence
  CN2171
gcggccgcacgcgtccaggctggtccttcctgtctcactgaggtctcagacctcatgctcattgggacttggctgaactccaggccgtcagcccaacagcgctaaagctacagccaagccgcagagagccgtggcctcccacgccccacgttgctgggcagagaagggaagcatttcagacaggcaggctggcccctggccagcaggtctccagatgccatgcaacacacacctgagcagggtaagagaataggtgtgtgtcaacagtatttgaaaaagaaaatagctgcacaaatacagcacttgttaacacaggtgtttacaggtggaattatttttccagggctgctatctcccagccttctttgtgcttctcagctcacacctgcagggactttcctacgaagccaaggcacaaaggggaagtggatagtccgtatcaattttaccacggaggaggtcagcgatcggcttcaggcctggctagttttcacagtttcccttgctggactcacttccatgttttcaacctgctctaacaggatctggcctgcgctccacttcctgcttggctaaggcagctgctgtgaccaccccaggcagtcacagcaagaagccatttcctggggccagggcacgctggctactctcgggacataattatctatctggtccttgtctcctctcccccaggagaggctcaatggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 255 - DNA, 1828 bp, Artificial Sequence
  CN2172
gcggccgcacgcggacttttatgcccagcccgagctcgccatcactactgccaggcagcagccagcccaccagagcctggccctggtggcaaccagttagcctctgtgacctccccatctgactccatcttccccctctgctgtggaccttgtctaatttctacccacttcagagactaggacaaagatggcatctccaaggcattctcttctccaagctgaagacccctgtgtctgggaggggctgggaggtgaggtggggccttcctggaggatactaaaagggctcctaaccctggtgtctcttccctcccagcctgtccctcttatgccactcatggcatcaatccgtccagagggacactccgatgactcacccaccacagcactttcacttccttcttctccagaggaggcgtctgacctgctgcagctgcactgaagggcctcttctcaggggcttccaaggcacgcgtgcggccgcaggaacgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 256 - DNA, 1714 bp, Artificial Sequence
  CN2173
gcggccgcacgcgtgtgggatgcctccatgagctccaacaggcagcctcgccgacctcccagctctgctcagttgctcagcaccccatggagaaggtgaagcccataatgaacacactgccctggccacttacttcctccaaccaaagaagccctcatctcccgggcctagaccatttccggagaccagcttgtgacagagccacaacctccggtcactctgtcagctatctgcagttcctcctttttcctttcctctctcccctcataaacaatgactgttgatgtttccactagctacagatgctgatgccaagattagctttggtcaagatgatattctccatcctccaaaacaatgaccaaaatgtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 257 - DNA, 1791 bp, Artificial Sequence
  CN2174
gcggccgcacgcgtagcaacattctgtgtgaaaagccatgatgacaaatgaatgaggtatatcctagggttatcagtgaaaatcatcatagtttgcactgtcagcctgagtgtgcagaggtccacagcaggactgccccacacaggaagaagacacagagaggaatctcttactacttgcttgcctaatcatttccacttaacacacagtgaaagcagaacttcgtgacatgcttgccctgtctgggcaaaggttctgcttttttaggaagatcttggaaaaagaaaaaaaaaaacaaataacaaaaagtcccccaaaacttggccatgagtggggaagagcttctcaatctttcatttattccactagcatctgtagtcagtttcttcatcctcgtgccatgtatccacgtgcctggcactgtgctggggactgagacctgcgtacgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 258 - DNA, 1918 bp, Artificial Sequence
  CN2175
gcggccgcacgcgttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 259 - DNA, 1827 bp, Artificial Sequence
  CN2176
gcggccgcacgcgtagttgctgagcccagtctgggtggtgctcctcccaggctcccggaagccccactccataggtgcaggcttacagacttccctaacaactgctgcaggccacaacctcaaactcacagcaaacaggaagcaggaggtgctgtcacatgtaacacagtcagagcttcaagcccccggaaaagctcaatgccagatttcattctctgcccctgatgatgccccgcactttcttaactatgcagctcagaatctctctgtttctcacgcagagaccaaggacaccatctgccctacactcaccccaggaaagcattgttggtaacattcctgaaatttagtcatccaacctctgctagactatttctagaaggcagcaaacccagcaggccttcagggacaatgtggacagagtctgctccctctttcacatctcattttgtctcctcttctgcaagctaaactaccctggctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 260 - DNA, 1737 bp, Artificial Sequence
  CN2177
gcggccgcacgcgtctgagctccaggaaggccacagctcttaggcgcatgacccacaccaggaggtttcagtctagacaggagctgggaagaacttaagcccctgggccaatcagcaggggaggaggcccagcctgtggttccaaacaccaggtcttactcagtgtccccaaccacaagccacaggtgagtcagcatgccacttcccgagctgggtcccactccacgccctcacttctgttcttagaaaaggacgaccaggcaatcttgtaaaacctttgcttcccattactcggcccacacagtcacctgtgtggcctctttagctacatgaatcttgctcaccaccttcagcttttcatgccagccagctgcctgccccttacacgttcctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 261 - DNA, 1777 bp, Artificial Sequence
  CN2178
gcggccgcacgcgtcagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgccccagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 262 - DNA, 1673 bp, Artificial Sequence
  CN2179
gcggccgcacgcgtgggccttgatcacctctgctgagtagctgactgcggggctggggctctgatgctcaggacccacctctctgggacccacagtctttttccactgtggcgtgtagtgatgtcacaggtggcagtgatgtcactgtggtttgaggtacttggctgtgagccccggaggaggaagtgtctgttcgctgatggggggttggaagagatcattgacttctgccccaagcgtgagccccaagtgtgcaggggggagtgcggggggagggctgttggcggcgcatcccagggctctggctctgcccttgcatctagcctgtcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 263 - DNA, 1801 bp, Artificial Sequence
  CN2180
gcggccgcacgcgtgctgacagcctagccaggtaagtcttgatggggaataagagggaagaaccctgaagccaccctggctgatgagtggccagaggaatgcaagctacaagacaaggtttgtaacctcaaaaagaactactgaggtcaacttctcctttctccaaagttggctgggcttttggctgcttcagaggaggtgactcaggggaactcccacccctggtgtgttctttagtttctcgaaacttatcatggctacttccctattccaaagccccgaccagagcaaattatctgtaggggagaacgatcttcaatagtgacacgagagtaacacaaaggggagcaggaaaatatgcacgagaagccacctgcatgccctccggtcgtcccccttggtcccatggggccaagccttggtggtcagaacacacaacgaaggaaagtcgcccagagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 264 - DNA, 1703 bp, Artificial Sequence
  CN2181
gcggccgcacgcgtcctccacccagaccagcagcccaagcccctagaggccccgagctgaggagccccagttggggcagcagtgaaggtccggatccttacctgaggctgcagggcggaggagagctcgccctgtgctccaggctccgaagtggggttcccttcagggagggcagggcttataaccccgaggccacgtgggccagatctcagggcgcccaacggtctcagagcgcgccccgcccccgcccgcaggggatgagcgccctccctccctccctccctggggaggacagactgacaggaaacagaagggggtgggcccgcgggagggctggggaccctctctcatgccctggggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 265 - DNA, 1590 bp, Artificial Sequence
  CN2182
gcggccgcacgcgtccttgcatcttttagccgacccatatgacttactcattttgtttacttcttactacttctccaatttttattttgattctaatctggtcattgagaatgtgacttcctcttcttagttttcgtttcccagctaggtttcatttgctgtgtcagtgactgtttttttttttctggtagtattagtcattgataaaaaatgttctataagaagatcgagtccaggaccatacctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 266 - DNA, 1829 bp, Artificial Sequence
  CN2183
gcggccgcacgcgtagcagcagcagcaggacacagtcaaagggaagatgtgaaaacatggagcttgcagaagaaaagtcagaggacacctctgttaggcacagttttaactctccaaatggactgggtacttcttccaactgtctactccacaatcacatgagcagtagccgcccccactgagtgctagctcagcacacccgggtgtctgattgccagtgattcttatagtaacactgccaggtctacagtcacattaaaggaaaccaaagttctctgtcatgccacactacacacatcctgtaagtgttctgatgtctgtcctgtgatatcaacaaagaggaagcaatacttcagtggaagaaaacgctactcagtcatggcacataaagagaaccctctaataatgtctcagatgagatacacctgaaatggagcatgtccgagtccatctgactagcggggaacacaaagtacagatgcatcgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 267 - DNA, 1654 bp, Artificial Sequence
  CN2184
gcggccgcacgcgtcacggtgggaggaaggaacatgttacatttcttcaaagataactgcagatcgaatgccttcatccttgtgacccgcgctgcctgcactgtggtgtgttttgcttggtttgcaccaatgccctggctggcggtcacttgctcttggtggccagtttcatttcctggttttgagaaaatgtcagggaggcctgttgcttgggcatactgtcactgagggaagtgtgcagttttaaaatgtcaaagccagcaggctcatgtccagtgcatgccatcaatcagcaaatgtccctggaccccgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccg

SEQ ID NO: 268 - DNA, 2478 bp, Artificial Sequence
  CN1781
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttgcgacacagccagaccctgtctcgagaaaaaagtaaaaaaagaaaaaaaacaggaagcataaagctccactgtgccgaagttgtgcagggtacacgtctctctgttcccagccccgaggcctggatagtatgagaggatccagccaccctaccccagtgcagccctagccccagcagagccaccacccagacctgcagccccgggctggactgggggtggggcagccctgagctgggcccatgctgttcacaggaaccagctgtctgctgttcgactggagtcctgtctctcacagagtccccggtcaagcctgggtgccctctactgcccgtgagccacacagcaggtccgggggcttcctgccgcccctcctgagcatgcaaccccacaggcgtgcccgcctgggcagctgcttcagggtctgggggcagcccgaggcgacgcccaagcaatagcggcccagcgccttccagaagtctccagacactgaggcctctccttgcaggcctggtcgcagctttattgcccccactctatggatgactgcatgggtgagcccacggccatgcagggagcccggtcctccgggctgggaccggccttgagatgggatgcatggccaggaggcgggcgatggccgaggtgaggggctcagggagggggctggtcatggcattcagagccaggttatgatggggcctggccattgacgacagacggggtgatgacagcggggccccaggatggagcctgcagtccacgacattcagagcagagcatggggcatgcaggaaagggggccagaggacctgctgggtctttccgggtgtatggtgccgaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 269 - DNA, 2043 bp, Artificial Sequence
  CN1782
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttttgtgtgcatatgggagatccaaagatgaaaacaaacgtagtcgtagaattatagattatttcagccaaaaggtccaaataaattacctaacctcaacttttctttttacagtgaggaatctgaggcccagagagattaagaagcttcacaagtgacatgacttgtgccaaatcacaaggtcatttagttgcagaactgggacaggaattcatgcccagttctcttttcaaaaccctgtggaaaaaagaagcacattgaatttagcctttgattcgtcatcagcattatcagaggtaaagcaaaagggagtattaacagatgttcagcaaaatggaggaggtaaattcagagcagatgttttgacaatgaagtaaagaaggagaactgaggacactgagagcctgaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 270 - DNA, 2080 bp, Artificial Sequence
  CN1783
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttgtaggaaacaggagacagctgaccagtgatatacaacattgccaaatggcactgacaatcctaagatatttaaatttgcagtttaatcaatctgctcattgtataattgtagcctgcagtgttcagtatctgaggcaacagataggactacttcaaggttggaagactgaagaagggaaaaataaaaggtcagtttagaatgggactgttctccagttagtctccttacaatattcagggaaatgtaacattttcttggcccaattatatgcttgtttgtttggagacagggtcttgccttgttgcccaggctgccatacaagtggcacaggacagctcactgcagccttgaactcctgggctccagtaattctcccacttcagcctccccagtagctgggactacaggcgtgcactaccatacccagctaatttttaaacgaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 271 - DNA, 2180 bp, Artificial Sequence
  CN1784
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttctgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcgaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 272 - DNA, 2161 bp, Artificial Sequence
  CN1785
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttggaagctggctggtggtcagagctgctgtttcattaacaggggcccaaaggccagggctctctggagaaggtccctgggtcttgaggatgtacaaggaatcttctagaccacaggccccacctttggggaggagggggtctgcagagctgggtgttgccctggctcagtgcctggcagaatagaagccacagaggcagctgggccctgtcctgccccaggagaaatctcccagggtgacccacagccctgcccacccctctgtgaggcaggcaggaagtgaaagaggaaggatccctgcgaaaggacccaaactgttttctgccatggggaggtcgggggggggatgccacgtctggcatctgtgggcggaggctgagcaggactcctctgcaggggtgtgtggggcaggcaggatggatggcagtgggcacttctcccactagaagtggatcccatagatgacacttcaagagccctgtgaacccaacatgggccacagctggagcggtgggtgggctagagaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 273 - DNA, 2285 bp, Artificial Sequence
  CN1786
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgttttgtcagtagtccaaaagtgatttcaagatttaattattcatcacgtgattaaaaataaaattaatattaacatgcaaatgtgtagttttcttaacaatattggccaatattattttaaagaacatctctgaatgttttcacgtaagaaaagagactgtcccagaaatcctggacccagttatcctgaagtttcctctgattcatcaagtatttaagtttccaggccaacagaagcctgaggctcaaatatttgtagcaaatcggtgactcagggcaacacagcagaaccctgagaaacaatgaagaaggaattgtttataatcttgtgctcagttacacaaaagatacacatttattttcaccaccacccaccaaagaccccagaggatccagaggctataataatagaatatgttaccaaaggaaatacaagatgacccattaaatttgaatttcagatactcaaacaaaaaaatttaaagtatgctacaggcactatttggagtatacttatactaaaaaaaatgttgtttatctgaaattcaaatttaaatgggcaatttttatttttgtttttgttttgttattttgataaatctaggaacatctttacctccacatacaattcaaggctgatcagtgaggggaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 274 - DNA, 2416 bp, Artificial Sequence
  CN1787
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttgcacttaaaagaatgtctggaacatagtgttatcagcgtttataaaataaacgaatatactacagcaaagatgatgaatgtttaaatttatatctagaaacagagattgagagcagagacaaatccacaagacgtaagaagaaaaaagtgatgggcttgatgattgaggaagaaaaaggactggaatgaagtcttgggattccaatggtcactggaaggggtcggcaagcttcttccattaattcattgcctttaattatttgatcataggaaaggagagtctggccttgtggaaaaacacacaatcagtttcattagaaaagagagagtcagatgtttttaaaacagcaacaacaatatgccctgaatagtagagaaacaaaagagcgattgatctacaaaggcaagacccagattgagaccacagtgaaccctgcaaaacagaggagcccctgggtgggaggggatataactggaactctgggaatgtaacgggcatggtgtgcttgtctgatggacagggcagcttaggggaataagtctctgcagcgttgtagtgaagagagaatacgggacaactgcaggaccacagctcagccaagagtaagcataaatttaaacatatttcttgatttctctaaagtctctcttttctgttaaatacaaataataatgcatgcttcattcagcaagttattgtgaggactaaatgagacagtattgaagttactatgtaacagtaaataaggtacagataatcctcagtacaagcacgatgaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 275 - DNA, 2331 bp, Artificial Sequence
  CN1788
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgttttccagtgttaaggatgagctaaaaatcttgtagggaatttgcttgaaaataaattttaccccctttcagagacttagtgtcctaaatgagctgatggggaacctggccttgtgatccttttttccactgaagcaaaaaagaagattgtataaaaaagaaatggctgcaggatccaggattttgcctttctttgtttcctggaagacttcaatatatccgctaattagaggttgcagtgagcagatattgcaccactgcactccagcctgggcaacagaatgagaccctgtctcagaaaaaaaaagacatccactaattaatgcaaagttagtaattaactggctccctttccctagaacatggtccaggtactgtgttcacttaaagactatcagagttaccaaaactgttagctggaatgatacaggcatggttaaaatcctttggttacatttatactgtttctagggaacctggcatagtgctgaactacttgcactatgggtgatttcacccagtcctttgatattgttggcagaaagaaaaattaatttgggtttgaagtgtgaaggtcccaagcatctggttgttcttaatcaaatgtgtaaatttccagttggaagttagtcatatttcagttactttcttttcaaacagataaaaaaatgaaatgcatattcccccagacagttgaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 276 - DNA, 2146 bp, Artificial Sequence
  CN1789
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttttgagataagcagagaggggaataaaaagaacagagatgggcggtgggatggagaagaggaagcaacagagaaagtgtttttttagagccagttacaagtaataaggctagtgtcagcttcacactaacttgtttactggcctccactgatagtgagaagagccacaatagagctgaacaaatagggagaataaacaagcttgaaacatgccctacttgggaggcagcttaattacacaaactgaagttctgaagcaaatagaggatcctccaagactccaggggctctgctctgccaagagaaagaaagcaccttatccctgggcagagaatttcattccagaggagggggaggggctgctgttggtggcttttgcagtgggtggagatagagtagagaaggcttgcaggggtgggctggcagaggggaagggccaacaatgaagttacagatggatgagtgggtttctgccacaaaatcagatcaaggagagggaggtgaagagggaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 277 - DNA, 2212 bp, Artificial Sequence
  CN1790
gcggccgcaacgcgtttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgccactgcctagttgagaccttttactacctgactagctgtttgtgtattttaggtgtttgtttctgttctcggccctagggacttgaggttgagaggtggtgagaaaagacccacacgccacaagcagatgatgattccatcacagaaggagaggaggaggcctggaggaaggcttgtctcatcctagcaaccagaggttttctctcctggtgtggcccaggaaagtgagaagacgtttccttccagctatagtcatggagccacaaagtcgggattcaaggcaaattaggctgctgatttgtatgttaaacaaggttaattccatccattagccaaagatgttttcaaagcgcctggcacaagagcgaggagcaattagtgtctttgtattagtggatgtgggcgtggggccaggacgttaaggggagggggatgcaatttctgcactctttatgatatcatcaaaagtaaatgaattatgaaaacaaaagaggcaatatgaggcttccagtactaattactgggtaggacagaaagttcacagtgaaggaggaaagaatgatcagagaaggacaaggatacggatcatctggcctgcaggtgtctttagacaaggtggggcttccgtgactccagaattcgatatcataatcaaccataggtaccgagctcgggattcagccgggagcttagggaggggaggtcacttcataagggcctggggggggagttggagccacgagtcgtccagccggagccccgtgtggctgagctccggcctcagaagcatccccgggttggatccttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 278 - DNA, 1848 bp, Artificial Sequence
  CN2345
gcggccgcacgcgtaggagcgaacatggtatgcataattgaaacactcctccttgtttgaaatgttgtctcctcctctgcagtcctgcggcaaagacaggcacacaggctttctctgtggattaattggtcaggaaagacactttttatattgtcaagtggcacttaagccattaattcttgactgtgaaactgcttttcctgggcaatgctctttaaggaaaaacttattcagtccagtgactggtgactaagggaacgatggagcacagggaattgggcgggatctagactcctaataatgcctccttagccaatgaaaagcatttcctattgagacccccaagagttcccctggccgtcggctccagctcggacttcaggcctttttgtgtcctgtttgctaaaggcatgcgggctacagcattcaagagagggagtcgttaacaaagggaaagagataaatgtaaataagctcacatttacagaatgagcggtttgcagtgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 279 - DNA, 1921 bp, Artificial Sequence
  CN2346
gcggccgcacgcgtccattcttttgaagttggcactttgatttctagatggttccccaacacaggttcttctcctcctcatcattatagctgccttgaaatttgagctggaagggaacattctgagacccagattgttaaatgtcttttccaaagtcatgcaataaattaaatggcaaagccagggcagtttcttgactcagtacagggtattttctttcattctttactcttgagactttagaactgttggtactgctttaaaattcatggcaagaactggtcacttttgtaattaacacctccttataatacatttgttttgtttgcttagccagctagaaactacatggagtctgtgctttaaaaagcctgccgaagtccttattctctgttttggtattatgtgcatgaaccaccaattggttccttctcaccttacacttgatgaagatgtctttctttcaacatctttctctattgctccccatcttctcttgctctatttatgatcagctgtctgtttctaaatagactttgtggtcacccatttctttttgtgccagctcctatccactgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 280 - DNA, 2336 bp, Artificial Sequence
  CN2044
gcggccgcacgcgccggtaccgaagctacccctaacacactattctacacacagaaaatgctcttcactaggaagctacccctaacacactattctacacacagaaaatgctcttcactaggaagctacccctaacacactattctacacacagaaaatgctcttcactagacgcgtaggttgtggccactgtgactcatatacatgtacatgaacgtatctgaagttttcagggctgatactgatgtgaggcaacccatgcaggcaacccggaggaactgtgtccctcactctgagacagtgagaacggactgagccggaaagctgatggccgtgagaggagcaggtttgaaaatcactgaatgaagtcatgttgtacagagggggcgggggtgcatactgtgggacggaggtgagtcacagtgcataagtgttggggagtcaccttgaacttgggccagaagagtagaaatattgagacttgggtttatctgcctcacatcaggtacatcaagttctggatggctgcccactggccagagacatgaggtggacggctcccttttgctgccctgggaaggccttctgctggcttcggccccactgagcaaagtctgcttgttcactggagttcacacagactccttgccaggcctgcccagaatcctgtctcctctgacttcctgtgctcttgcataatatttccttgctccctgaatggctggccccagtgcaggagcagctcactcacactgctggaccgagggcaggatgtagagggagggcagggatctgcaaacgtcacccaggggtgctctgggctctgagggtggagggcaagaggggcagagccccctcaaattctttggaagattatagcacaaggggagttgggaaggccctgggaccatgtgcacacacatctgagctcgattcagccgggagcttagggaggggaggtcacttcataagggcttggggggggagttggagccacgagtcgtccagccggagccccgtgtggctgtgctccggcctcagaagcatccccggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 281 - DNA, 1821 bp, Artificial Sequence
  CN2268
gcggccgcacgcgtgtagactgaggccccgtgtccagaataattgtgcacttccacacactcgcagtccagcactggagtctcagctgcttggctcagagctagtgatacatccctgaccccagagaccccctgtgagccggggtttcctcgggagctgctgtatgagctttcaccaggctgagtgtgtagagtaatggggtctccagaggaagggggtgcctcacaggagggatgggtaactccggagttttggatgcccccagctccagcatacccagctccttccaaggccacccagcccccgctggcttcaaacttcactggcttttggcaaatcctgttccgccaggtcctgagaacggctgccggtcggagcaaactcaaaggccctttacaaaacccaacagcccacccaggccttgggcccctcgtctgtgatatggagggcaggtcctcttcgacttccccaaccccagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 282 - DNA, 1815 bp, Artificial Sequence
  CN2243
gcggccgcacgcgttaaaaggccagggtgggaccagactgcccagataagaggcagagacacttggaagcaaggcttgaatgagtagtcagctagtatttatgtagtgctaggcatgttgggggaaaacagaaaaattataagacgccatgcagtccgtggcggagcttctggtgagagtcccttgtgtaagaatcaggactggtgcctggttctgcccagccgatggaagcctgccatggtttttgagactggctggctagcctctgtgtagagccacagggagtagtgggcaagccaagggtctaggaatgaatgagttgagtctgtgccacgtactaccaatgagtcccattccctctaaagctgagtttccatagctgtgcaatgtgaaccgcatcaagacttgccaagcccgagcatacctcagcagtttatgggaagtggaataagcctaacaaatgtgggttctgagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccgagcggccgc

SEQ ID NO: 283 - DNA, 3717 bp, Artificial Sequence
  3001
gcggccgcacgcgttctacaagtgtctcttcgaaccaaaggacatgcctgctaaagcatattttataatctcttaagagctggagtaagccttagtgtggcaggtctgcgtgtcaaataaagggtttgagatgacagaacagcagcgtcctctcagaaggtccagctgagcccccagggtgagggggtgacatgctgtgcacagtggccctcatttgagcaggaatgccgttcaggtgcctgctgtgcctccctggtgccaggcccagctggctctctaccattccagccctcctttgccacatcagtttgttcttaattccttctcggaaactctgctcctttgccgcacaccacgtgttcagccaggccccatctgacagctggggcccctggcgcaaccccacagacacccagtgtccctttcacaggctccggtgagccaagtctacttcctttacaacccttttataggccctcccattctggagccttgtgtgccatgccaatggcttacacacttgatgaaaggactcaggggctgagaacttggatcaatgaggtctttatttttgaacatcagtaaacagcacaaatcagttgaatgggtgcagccctgttcgtaattccaatgcttgctgtggtttccagccagcattagacacacagagaaagtgctcgttaatgctagctaatgaagaatgtggccctttttccctaacttgaacacactccaagacgctggcctgaaagatcagtgtgacactggagagggtgaatgggaaaatctttaaccttccttttgaaacagcccattgacgtggctctaaccactttctttcctcttctttttggtctgctctctggcattgcgggatcagcttgacgcaaaatacaatcttttttaagacccagaaaatcgtgccaggaccgtttcactaactgaactacaaatcgtgtaattagagatgaaaagtcccaggaaccttcaacttgtgcctgtgcctttgtcaaagtggacccctgtcactgtgttttgggggttgttcttgtcactcttgctgtttatttgtgaaaccactcacagctcattcagtgccaccagcaagggacatggcctccttgtttcaactaaaaatagtcattggtgtggttaaaaccacaggaaagtaatctttaaaaagatttagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 284 - DNA, 3686 bp, Artificial Sequence
  3002
gcggccgcacgcgtcacttgcaggtttcttcttccagtcccagccctctggcccacaccccactgctgaccacaggagcctctcacagtgctcactcagggcttcaaaactctctccctggcagcttctttctattctgaagtctcccagtccagcacaaattagtcccctctcctggactcctactgcgccgccttggtacatcacagagcactggctgagaaaatcgccctttagtccccgcaaatcactctcttacctgctccactgactaggcctgtgccattatttattagggaatgagcgctagctgttgagggtcaattattccattgaccaggcattacaataattcctggtaattaaaagaggtacttatgtgaatctggatgcgtattgaaagaaacattagtccttttgtcagcttggcaagtctattgttctgagccaggcccaaccaattaacatcttttgccaatccctgtcagcaggggcttgcaaggaggagagaaaggggggccggtcagatgctaatttagatacaattgtgtcagggtgcatgggaggggtaactctgaagaagagactccagtttaatgaagcaaacagcttgggtcccagtgaccctgcaggggtaattttaaaaggcccctctgtgttcctgtgccaaattgcagagggccagcaacaagaagcccttcaaaaaaaaaaaaagagggagcaggataatcatccacttaatctgctcattaaacaaatctctcaggcggacttaacgtgaattagcacttctctgaaaggggcagccttgatgagcagcagacagctcagatcatttggaaggtcacagttttttttttattattatataagcccagttgttattaatgtattcatatttgaagaaactgagcagagacctgctttcattcaatctagtgagcaaaacagtacgttttcctaactggaaaacaaaacataaatgctaatcaggtcccagcagagatcaaatcaagctaaatatagcaggcaccctttgtggttttttttgttttgttttgttttgttttttgtttttttttaatacagaaattaaggaaagaaaaaaaaccattgaattaattgtcttcctctgtgcttcgcacctgacaccagcggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 285 - DNA, 3929 bp, Artificial Sequence
  3004
gcggccgcacgcgtgactcctttcccgtttccatcaaacctcccccctgcacacatgcaagaccagttttatttttgttgagctacacattcggttccctcttctctccggtctcattaactccactccgtcagattcccccgcttttctaatgattaaagtcgtgggctttttaaaaaggcctccaattagcacctcatcagctccaattagagcagacaaaggccgtgtaaagataactcagtgagaggggcgggagcaacatcatgtaatcacttaagacaggctttgagaattctcccagcgacccacactgggcctattcacctttctttcttccttttggatgcatttaagactgtttggctgggaagacaggccccccaggagtctcataattcctcattcacaggctacctgtttacttctgggagagtccaaggacctaaacaatcccatattgtacgcctgcttccttaaattccagatccctaatcgtgtgtttttggtggccctcagaacaagttaaaggccagctttatactcccagagggttctccttgtactgtcttctaattacaggagagagtaacaatgtattttttttttcaatgagagttctttggagcagttaatttggtgcctgtactaaatgcccccaaacattaattagggtggaagaaaccctaattccctcagcagcgttgccctccatttagttccctcgtttttcacataggcctggacgagtctccataatgaaattacctcattaatgcctttattcttcacagtaactcattcaaaaccgaccatttagctttaattgaatgctgtcaaaaggaaagaggtgcattcatggctttgattagcaaaaaattttcccccctgaggggcagacagatttaaattatgaagatggtgagtagtgagttataattgggtacaagcagcactttaggagagctgaaacgttttcaaagccggggttggccagtctgcggactattaactacgtccagggccttgttctctgtttgaattgatggcaacttaactatccaaaagaaaatggggtttactttttgtttaatacacagtggggttctatttacccacagagcgatcgtttcttcatgagctctatctttgttcccctgataatttattatttgtgctttctaacacgggtgctggagggcgccagcgccgtgcatggtgcagtttccggggagagttagaatagagagtgcacatattgagcaactgggctgctggcccagcgcctccctggggcagacacagcgaggtgaagccccgagtcaggagcaagtgggtgcagtggaaccttgggaactcagccctcagaaagtctgctctgacttgatgcaacaatgctggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 286 - DNA, 4204 bp, Artificial Sequence
  3004
gcggccgcacgcgttattttataggcatagactttgccatgtaagccaagctaagtatccctggaccttcaagtgatctgcctgcctctgcctcctccaccatcatgaagctcaccattgtcacagcagttttttacctggatgctggggaatctgaactcaggttgtcacatttgcaaggctggtactttaccaactgaactacctctttggccctactttttttgttttcttgagaatgttctagaaagctctctgttaggtaatattttttttcatttgaagttcaatcttccctttctgtttctaagactctcagagaaaattaaacatttattcttctattaagcttggacaagtactaagattaaaaaaaaaaaaagcaaaattagcattgctttttcaaggcaaaagcaaagacagttcctttatttaataaccttcactcatacaagaaccaagctcattagtcaagtattggccacagaaaatgaaactcttaagtctccatgaaataatgtctttggtcctatttagccgagtgaaggatttagacacaaagcaaacagaaacttgaaatctggtcttctcttctctccagaatatttggtctaaagtaggtcagaccctgctgcaactaatcttaacacttcttttgattctttcactggctctacttagaggagcttagagaggggaaaattcatccaattagttaaagaaaaactgcaaatgagagaaaaggcctcctgaattgtggtgcggggtctctgtctccagcgccaatgagttcatcaacttgaaaatgattttcaaaagaatagctgtctatgaggtaatcattaatcccccggatgctttagtggctgccctggctgccctcaaccatccattctctctcctggagtctaagaaggatgctgacacagctctggatgaagccaagaccatgcctcaagagaagaagagaaacctagaatgaccctcagtccttcaagacagccatcgcttcccaaaaaaaggcccagcaaggggtttcaaaactctagagttcagaagaaagttgccaggaggggcctggattttgaaggtgtgtagaggaagggagtccactgaaggtgttcatagtctacattggtgtgtgcacatagcgtctaaatccaagccgttgcttttccttggcctctcccatggattcccacccgaaccacagagtgggacccttgtttccaagagtactttcgccaaaaaagtgcacagcttttcaccacttacgtgaaatgctgccagctaaatatccttctgaatgatgtctttgagacttcccaggcacttaagctcctttctaaaccatcacaggccaacaaagtctgtgaggttttaagggatttttgctggtcccgtggcttattctttgaccacatcaaaatccaagggattgctccagaaactgtggatacagtttcttttcttgttgctatgaccaaagcaactaaagaaggatttgtgtagctcactgtttgagggtgtgatccatcgcaaagagggaaggcgtggggacaggttcatgagacagctattcacactgtatgagaggccctgaagcaggggagaaatgctggtatgctggtgctcacttttctttctttctttctttctttctttctttttttttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 287 - DNA, 3537 bp, Artificial Sequence
  3005
gcggccgcacgcgttgcctgtgagtatgtctgtggggtactctcttaattaagttaattgatgtgagaagacccaggccagtatagggagcaccattccctaggcagggggcgggttatgaaacaaatgagtaggggaaattgagctgagcacaagtagcctgcatacatgcagttagttctctctgttcttgtctgtggatgtgatgcgaccagctgcctcaagctctcacccttgtaggttccctacactgatagactgtaacctggaattgtgagctaaatgcagccattttcctttcaaattgttttttagccagagtaattttacgacagccatagaaaccaaactagggcaggcccctaaacacagcatttttaacaagagcccaggcactgctctttctgctgagccttggttttggaaagaaaggtcaagagccttttatgaatgcaggatgcacctctcttatgcttcctccccttgccccgtctccaaggcatccattgagtgcctgtgtgcatgaggctgggctccaacttgtagcaaagaaacaagacacttggcattcaaaggggactcggtgtggacccaaccttggagctctcccttcttcttttattttttggctaagagcaaaatgaaccacagcatccagttcctggggcgcacaaccatggccttacttttcagggaaacaaacccccaaacacttggagagaagctggctttagggctgtgcctgtggctgtaaatcgcctttgaacattgtggaacatcttgggcctttccttcagaagtctttcgaaattgttgacgtccctgctgtctgtaaagagacaaactgctctttcatctgagctcacttggcattgggacatggcctgtctgtccccttggcttgttgtttctaacctcttcctttctatcctgtcttagtctggagccctgtcgctctgcattcaatggtgggcattgtcacacgagtgaatctcacttagcccaagagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 288 - DNA, 3660 bp, Artificial Sequence
  3006
gcggccgcacgcgtgactcattcatttctctcttatcttcaatgttagggactgattcaaaacagcataatcaaaacaaagcagagcacagcataattaaaatcatgtcttctgaataggtaattacaaaactaattggatattggtaattattttctttttacctgttcctggctcctttctcagttaatatgtagtgctatgtacagatgaagttcagatgcaattatgtacagggtctatctcaccaccaggaagcaggacttttctgtgtgatcttccatttcctgcaaggactacagaattgaggtacaagtgccttttgttttcctcaagttgagtccttctgttttctttgtcactggctttcatcctctgtcccactggctgtggctcagtgtttatttattggctgtttagtatggagaaacatccagtctttcaacattgacaacaaatccaaataatgagcctgcccatcacgctacactgggtatcatctttgcctgttaggctcttggctggttttttgctgtatttgactatcctcaaagtttgggagttctgactgcgggttgttattttccaattcttattaacacttgccaaatcttttgtcatgcatctttatactcatgacagcttctaggtcaaattttagttttgatcactggatctttagaaggaaagctaaggaactgacagacatagccagctcctttttttatgctggcaatggatactgattagctgtgtgctagttgttgaagtcatagcaacaagtcctacttactatcttttaggcatctcaattaagtttctttggtctttggaaatataactacaattaagtttcatctcctggagaaaatgagtatgttcaggagaacaacttcatagagttaattaagaactcttttctagagttcatttttaaactggtaagttatttgtactccttcattttccttttgtttccaggttttataataggcttttgatggatttaatcttttaatttcaaactgactatttgccaagattctggatgcctttgctgaggctaccaagttaagtatatgcatcagcaaccagaggaaaaacactaacgttgggcagagaagcaatgaagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 289 - DNA, 4033 bp, Artificial Sequence
  3007
gcggccgcacgcgtgagcaaagtatttcctgacaccgagccaaaataatgaagaaaataaagttggcccataataacatcggggctacaggaaagacactcaacaaaaacaagtcaccccctggtactcctcaaactttgttttaatttcccacagtggcacagaaagtctcctggccacaagttacctatcatcttaatttctgcttcttagagggtttgtgtttggtttttgtccttaatgagacatatttgccaaagaggctttcaaaaggcattttttgctcttgcggaagagtaattaggtcggtacctctttccctgccagcatcagctgcctaaagagaatcctgcctagtatttaatgcccaaacagaagaagcatcatttccactaattggtcctgaagttccgatgttcccaaagggtctttttattttgcaaggatcagaaaggacacacgtaaaatgtgatagcgtcaccagtgaccttcatcgctctcatctgcactattaccgtcatcctttcttatatttttttccccccagtggacgggaacacaatgccaactgagggagtgaggaaggcttttgcaagtttactgctgatggcatctctgggccaagttcaaaggtcacagcagaaatgcttataaatgagagaaaaagcacaaatgcataaaatatacaagagtttgatttctttgatgggtccattttagggacagtgttaagtactcgggggaaaacgttactgttggaagatgaggatgcagacgcaagggaaatacgggacgattcatcaagtgaactggaaatatagtatatactgctaactgtttttgtttttgtttctgtttttgtttttgtttttcctttccacagcctaagaggagttttggagtatcatatcacgcactcttatgacgagaagggaaacagatgataggaatgggggatgggcatgtagcagaatatttacacaaacttctcgtcattgaaagctctggaaatggccttattaactctcaggaagtttccaattctttaacgtaatgatcaggctacacggatgcccttagaaacatggccaagcaatcattaggcagagcttcagccatccccattcagatgggccaaagaaaccagactggaagaacagactgcctgctctgtcttctgggttaagttcccttttttttgcttattcttctttttttgacttgtaccttgaaaatgaagctcaaagccctatcatttcactatgttttatccaagtgacaggcaggctctggctgtggccttcttctctctttaaagagccacttttcactgcagaagcccagtgtcaaaaggcttgaggtgaataaagaggaggagagtgttaaagagaccctttcaaaaccaaaattgtatgttcccatgagcatggttttctgtgccactgaaagattggctatgcagaaacgagcctgcttgccagtgtctatactgtctgcttactttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 290 - DNA, 3328 bp, Artificial Sequence
  3008
gcggccgcacgcgtatgcaggcaccctggctgattcagacactggacaggaagcactactgcctgccgtttcttgggaagcgacttccagtctccaaacattttcctctgctgtgcaatgggcatccacacacttagcctcctgtcctgccccgtagggttgagcatcctcagacttggaccctgtgggatctgcagccaggtgcagaggctgtgcacacctgtaacttcagtacttggggtgtggagacaagaggagcaggagctgaaggtcatccttggctaaacagagttcaaagtcatcctaagctatgtgagacactcatacaggaatacattcttaaaaggaacttttgttagccccacctgcaggaagtaagtttgtgccaaagccctgggccccttacctatgcaagttcctgttaggttacaccatcccccactgagatctaagccttggaaaccccaggaaacaactgaatgtccagtcctttgtgcccttcctgatgagagagcctctctccccacctactgacacttagcaaaggctccatcacggccccacctctggttaaaggaggaagctgggtctgggtcggaaagtcccgcccaggtgtgaagcaagcccttcctctgcccacacccttcaccatgcccagaagataaagtacacaggatgagggccagctcatacacagccctgcagtcctgtgcggcacgtccagcatgttgtttgcctgtgctctccttgccctcctgggtctggcaacctcctgcagtttcatcgtgccccgcagtgagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 291 - DNA, 3109 bp, Artificial Sequence
  3009
gcggccgcacgcgtgtgctgcagcttctgttcacagatagaaaccatcattttgttgtccacggtctctgaagagcaactgacagaggaggctggtggtacttgaggagagcagcctgtggctccgccttttccttcctggagcactgctagctctttcctgaagcctctgcctggcccacagagcagacgtcacaagccagcttcgctagtgagttattacagacaggaaaacatctagagactgatcagacccaaggaacaggctgagtcatacagcaaggatgcgacttttctgagaatgccaagactcacaggatgtctggtgttttatagataacaattgttagagaacacaattatggcaggatgaagtcagtggggagagctacagtgtctcacagcagtacttcagattctgcatctgtagatagagcatcaagcagtgtgtacctgtcggtgtctgtcttgcttaaaatacagcctaagactgacagaagcaccttgagaggatgaaacaaccactcataaacagagaagtctgaaacacttatcacttcccctgaacatcagtgtctcaggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 292 - DNA, 2974 bp, Artificial Sequence
  3010
gcggccgcacgcgtaagtgctgcagcttctgttcacagatagaaaccagaactttgttgtccagggcctctgaagagcaactgacagaggaggctagtggtgcatgaggagagcagcctgtggctccaccttttccttcctggagcactgctagttctttcctgaagcctcggcctggcccacagagcagacgtcacaagccagcttcacaactacagacaggaaaacatctagagactgaccagacgcaaggactaggctgagtcatacaggaagcatgagacttctctgacaatgccaagactcacaggatgtctggttctctagagttaacaattgttagagaacacaattatggcaagatgaagtcagtggggagagctacagtgtctcacagtcctacatcagattctgcatctgtagagagagcatcaagcagtgcgtagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 293 - DNA, 2923 bp, Artificial Sequence
  3011
gcggccgcacgcgtagtcttagtttgtctcaggagacagaaagagatgaagcacagaagtccagtggttagggctgatgctgttcctgaaacccaacagggagggggaggaagggagaagggtcagctgtgttaggggcctccagacaagctggccagaacaatgaagaacaaagcctgcacgcttttccgctgaagctcagagcctggccttggccttctgtgaacagctctaggaaatggctgagattccagatttggaaggaagagactggtaaacaggagctgggctctgaggagaaggcagtctctctgggtttcagggaggagccaatacagtcagcttagttgttgtgtaggttgtgtgctatgtagccatagaagacaggtgtcaggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 294 - DNA, 3064 bp, Artificial Sequence
  3012
gcggccgcacgcgtagcagcaaagaggatccccaccagaccatactctggaagctgccctgggccagccaaggccagctgggcccggggtcagttgctgtgggtctgagtgttcagcctgtccagctcagtgcacctcggtgctggggaggaagaggaaatgatggttagggtaggaggggtggcagggagagagggtgggaagagttgtcgcctgtagtcctcccgtgtccagcccccacaagcccgggatgggtgtggcctggaagtctctggaagggggggcattagaggtgggaggcaggttgtgacaaggacagatctggggatggttgggctctctctcccatcccttcggtcccttccatctgcattgctggagcacgggagacaggaaagggaggaagccagtggcttccgcctattgagaaggtttggaggcaggacattgttctggggtctcccctcctcccagcacacacacgctgggaggaggggagacacacacacacacacacacacaaatacaaaatgaggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 295 - DNA, 3094 bp, Artificial Sequence
  3013
gcggccgcacgcgtcatctggttggcctggacctagagcatgctggccctgccacatggggtgattgactaggtgtgagcaggcccaatggagaagggcactgcattccctccccttgtcaggcttgttcaaggaacatggagagatacgccatttccaagcccaccagcaacattccagtctctctacaccttttctgataagttatgggcagccttttcagtgatggccacccaggtaggtgtaatggggacatggatggtttgattatgatggcgggcatctttttatgttcatatttatcatttttataactctccagagaaatgcctagacgctagctggaaacttttcaggaaatggaagtgcgtatgactgggaggagttccttttgggtcacaaacatccagaggaaacagaggagagcaacacctggcagggaggaggtgggaggggcatcactgggaaggggaaagaggaggagactgctgagatcactgaagaggggaagccaggcagtggtggtgcacgcctttaatcccagcacttgggaggcagaggcagagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 296 - DNA, 2922 bp, Artificial Sequence
  3014
gcggccgcacgcgttcagtgtgaggatttcatttaagaaaccctaactcagacatgaagtaaacccttagcctgcagttagcatcccggggattacagctgaagtgtagaggtcagagagtttctcacctctggtcccctcccagttctctaaggcatgagggccaggcaggaagcatccgtttcctcaaagctgcttccctactgggacagagtctcagtcacaaacaactaccaccaccccacccctccctttcttcccttactgctgtgagctcagaacaaccggacaaaagtgtatgggacaaggagaggagccgagagcagccatgggctctggaggaacgggcctcctggggacggagtggcctctgcctctgctgctgcttttcatgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 297 - DNA, 3072 bp, Artificial Sequence
  3015
gcggccgcacgcgtatgccatgtgctgaaacccctgggagctggcttacctgggctgtagaacaggataagaagagacaggctccagcaagcaaaagaagacatctcaggtggggtctgtggggtctgtggagtctatgggcttcaggggcacagctgacggctgcctggagggttagggagagatgtctgctacaggtcggggagtgaagcctggcgctcccaactgaaatccacaatctcctctgtgccagtgagctcatttcctctaattatctgagatcaggaaacaatatgcacagaccagctcccaagcctttagggcctcaagaattcatgcagaggaagccaggaagcagcagataagcaggggtgtaacagggttctctcacgttgcatgctccctgtgcggggataggaaagcaatgggaaatcacatgcaggaagtgtgtgtgcatgcatgaatgtgtgcaagcttgcatgcacttacgtgttttgtgtgtgggtggggggagtgtacatggaatttctttaactgtacattgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 298 - DNA, 3109 bp, Artificial Sequence
  3016
gcggccgcacgcgtgacgctgagcagcggctgcctcacctgccgggcgctccgcagctacccaatcagctggggtcgcccggcagcggctgccatgttctccgcttcgcgctgccaatcattgtgtcggtggccaatgggcgacagggccgggggtcaggtgatctcaggccagctggctccccattggtgcgcgctgcccagcctcccgctcggtttatgtgcgaggagtgagtgattgactttatcagtccaaggacattactctggaggtgaagaggcttggactcgcgaagcgagcagtgaggttcgagcctgcttactgcaggctgcctgccctctggccacgttccgcctctgcttcttggtgcagttgctcctgaaagccgggacccgaggagcctctggccccgtggttccgcgctcttgagtagaggaggggtgtccgggacaggattgacaaaccccgccctccacttattattttgcttatttttctttgtgcgctcctgttagtttgttaagcagatttagtcctagagtcttttctcctcccttctcctccctcctcctctcccatcgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 299 - DNA, 4290 bp, Artificial Sequence
  3017
gcggccgcacgcgttaccctatttctgggatttaagcttcagaactgggcacaatctcaaccattatcctctgctgcagaatgaaaacctccccagccttgataagcaggaagggaggtcacctcacccgctctgggaacctgcagcctccacctgctgaggggctggctctctggagaagggaacacataccacaggggacaccccttcactctcctgtgcataaacaccctctccgctggagagctgcctaacttttctatggggttagcacttctgtctagtaggtcgcacttgggctgctctgtctgtctgtggatcttgtctctggtttccatggttcgtgtaacaagtgggactcttgaagtcaaacaggtgggaggtgttccttgaccacgcatgtgtgggatgccatctgcctgcagtcccactagcacccgaggctgaccccaggctcaccagcgtgtggctggtcactagcccgatgggaacacggcacagaggcaagtgtggcgagtcactacctaggcagaacgggaaggagcacatgaaacaggctggcattgaacttgacagagatggcagagattaagaaggcagggagaacaatggggggaaagccagaaccaggggtttgaggagaaactgtaggggctgctgaggcagagctttcctgaagggaaaaagaacagtaagaaaaacaaactccatttcacagaggcaacaatagaacaatcttgcttcttctgccctcaagtttattggcctccagaggctctgtgcttccaaagattagccttcccctgggaaattaggaagcaaatattagttctcctctcatgaggtcattccttgtagaacgcttcctcgggagctctgcgctgcttggctttcgaagccccatgcccacccggagtttcaacctggagtcagggaaaggcttagaaattatctttgaatcccaggaagacaaaacaggaatggcctcaagcagggcttccttctgaaacctggggaaatggctacttctgcctggcctgaattcaggggaacagtgcaccccacctgctccgactggcagttaaggagggccacattgaaggcagcagactcccagctgtgctggcgggacaaagccttgattttttttttttaaatctctgattagtcattgtgtataagaaatgttttgagttaaaataatatacaagaatttccttagaaaagaaaatacacacgctcattttttggatccacttaacacacttagcaaaaggacatttggaacaacatgacacgtcttagcttcggagaagggtggggtggactcatgccatcacaatggagatggatgtgtggtttattggcctctcagccacacacaggtgagtgacaggccactgttattcaactgtttaatgccagcttctcataaatcaaggtgacgcctgaaaagattgagtctttaaatcaaactgccttttcctatttcgaatataatttgggctgttgccaaggactctgggaaacagaggactacaagtgccatttcaacaagaaacacacccatttaggaccggatgcagagctcagggctccggaccacttgccaacagagtttcacagtcacatgacagtgacatactgctaatggggttagcaagtgactcatggtctcatatctggagaatgaagactggggtgggtgttagcttccaggaccgccataaccaacatgccagtatgacagactgccccgtggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 300 - DNA, 3231 bp, Artificial Sequence
  3018
gcggccgcacgcgtcggaagagcatagagcgtgcctgtggctcacagtctttgaacatggatctctgagcacctgcaggagccaggctctgcagggcacagcggcttagacatctagacctaggcttccaagtgacccccaggaaaatcctctgcttttcctacccccatggcgttcacaggcttgcctccatcgtaaggtcaggacgtcggcaagcacagccacaggactaggccagccaactgtctctgtcccaggcggcaggctctgacgtgttcctctgggtttggagtcaaggcctgccgtgtttgttccctctcaccaggaagtgagggctttccttcctgaagcttgggaggccacgttccttttcactccccaaagaggaagccttctctgtcctcaggccagatatgtggagggctgacttcatggcctgagacgagtgcacaggaagccgtcttacctaagaagccctggaggaagcctccacaggccccacaggaagcacagccacgtcaccttctccagcagggaggccagtctctgcccagctccatcccacctgacctgccatctgcccagcctccaacccctgagacgtctcctttctggcctcctcaggctcctgagcacatttgtgagtttacaaagatcagaggtcgccggagatcagaaccagtgcaccccactgccccgcaggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 301 - DNA, 3575 bp, Artificial Sequence
  3019
gcggccgcacgcgttggctctattggtgctagagttgaggagaattcaaaaggagacaaagggattcttcctttgatccctgctagcgtggagaggagagtttcagcccctgaggaaccctgcagacatctctgggaggtgaggaggcccatcctggagcaaactctgctatttccagaagaacgagaataagtcataagaggccactggctggtttgtattaattgtcactattaacagtgtaaaacttcaaaggagagaatgactggcaacaaaattagtttattatactgggtacaatagaaattagactagtcccctcctcttgtcccctttaagggatttcctaaggccactgggaacaccatccctggactttcagggtgggctgcaaggctcaagctggttgccaggaagttgtgccgggccaaccccatgttccttctctggcctttgtctgctggtttcaaaggcattccttgggaaagggcattggttggtgtaaacagctttgaatctgaagagtctcacccctctctggagcacttggaaggtccagggttttccttctaggaagtgggaacaatgggaagactttattttagcagcaagcaggacttgtgataagagtgcacctcagagctggtctctgtgtgtctagttaatgaccaaacatggggaggagcaagaataccagcgttgccttaggatgaaatgactgacattcctgaagcagccccagattcctcacatcccaactggcaagactcaagttcacccacttgtgaagaggacacatgacagccctcagtccttcccttggctttcagcttattgtgtcgaatgacctctcttcaactagagagtaatgatggatgattggaccattgtttgctaggcttaactgtgtcaggggtcaagatccagagctacagagaattcagctttcatggggaaaaaaacctagaagaagacttccttcatgtggctaaatatttggacatcagaaggcagtggctctgcagaagcaatctgaaagggcagacgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 302 - DNA, 4161 bp, Artificial Sequence
  3020
gcggccgcacgcgttcgggaacatgggggtcaagtgagagagccaggtgtctccagcactcagcatgatatctgacacaaatcagacccctcacttttaacactgtaccctaagacttggggcacaggccagggactttccgttctaggctctctggctcctgcttcttggattctgatctccggtcttatcgacttcatttccaaattagaggttttttggaacccaggggctaccaggccaacctggaagtccgactgcacatgctgtatccgtgacagagttacagagaacagggactgccctgagtgggacaggccgaagagggactgccagagaggtacagaccccacccccacctttgtaagcctgattgcctacccaggccaccacaactccatccagctctgtccccgcctttgttcctgagtctccaaggccccctttcctgccaaacaaagcccccagccacccgactgccgcccaacaggcacctggggcctctgggcctgggaatcaaagcctgttttgcaaaggaggcccagtgtttggagaacacccatcccctgctgcccggtccttcaaagaaccggcattgttctgcgctgagaaggcgcctcttgacgcgctgggcagggtcggcttgacgctggtggacctctgatctcaggccaggcccccagccacttggggggagggtggacttaggggccaaagagggagcaacctgtccttggggcactgtggtccttcctcattctctgcccacccgagttcccatcaccgagttcattgagacccaggctcttctacctggtgatctggacaaggcaggcctcaggaggcaccaggacaagagatgagatagcgggcaggattttagtgaccataacaggtacgtcagagactgcaaacgtattaggcctcagtggcatgtaactgtgattctagtacttgggatgctgaggcaggagaatcatgagtttgaagttaaccggatcttcaaggcaagaccctgtctctaaatcatagatcacaggggagtgtgtgtttgtgtgtgtgtgtgtgcgtgcgtgcgcgcatgcgcgtgtacacgtgcgtgtgcatatgtatgcatgttctcattttacagctcacagaggctagagaggaaactgggcccagagcccggttcaagctgtgaactgacaggccccgttggctcttttatttgttgaagaaatatttcccaattactttcttgtccattgtggattccactgcaagctaacattagtaaaggcatttaaataaaagtctgcccagacacaaactaaggccacagaactggctgtggtgcccaggcgggtcgtgaggagcccaaataacactcaaaagccacctttatttgtccttcccctctgccagtcacagcatcatgagcttctggggtggtgtgtgtgtggggggggtgttagtctcactcctgtggcactgcagaagtctctcaaggcacagagagagggcaagcaatgtgttcaaagtcacccagaaactgaggttagattggagcggagagcctcatctcaggagctcattctgtccggtcctcccctcagatcacacttctgatcaagtggcacggcagaccttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 303 - DNA, 4001 bp, Artificial Sequence
  3021
gcggccgcacgcgtagaaacctgtaattttcacattcaaatacaatcctgcggacttttaattaacctaactgttcctacaatgcttgctgagtaccatgcacctgcaggccagcactgtggccttgcctcctgacgcacctgcagatctcatcctgatgctctacgatgagtagctaagggagaaaatatgcttgctggcaggatccccttggggataactgtaggccggtcctatttcataaaatagcacacagaagtaggagactatcggtgagtggcagggaaagcaggcttcacagagatgttgagtaactacaggatgtttagtctagagaagaaagattatggggactttgatggttgttttcatcatttcaagaactattgtgtgactacaaggagaatcttgagacctactggggctattccagttggccaatagagtgagaatgttagagagagattcgttttgatgtcttcggaagcctgctctaaaggtatctctgcctgtgagcattccagaagctggctgaccgcccggcctataaagaaacaagtttttgccagtaattccagtgaatgatctttgaggactcctcagacgttactccttttgttcttgtcctccaaaagaaatggaaaataacaacactttccctgggtcttcctgacgctttcagagtgacaagaatgttaccacagggcactgtgtgttcccaccttcccccaccttcaatggccggccactgcagcaaccttgacttagttaactgaatctgttacagtcaacagaccttggtcccagtgacattcttcctgccctggtcacatactgctgagcctgtgaaccgttactaagacctcaactgtgattgctttggcccacccactggacatacaaattctagtgctgaacagaacagtcaagaaagagggggtatcttgcctcaaggtgaggtaaatggtaggaagacgttcacagagcagtgcccacgagaggcagtgcacacaaaggttccacgtacagcccacagcttgacgtaggagtgtccattctctgagggaatgtcaaaggaagggaggtgcctctcagtgccctgcagctgccctaatcttgactgtggctgcatctcccaggctttgcagtctagactaccatctcctgaacacctgctttgttttttggttttgttttttttttcgtaaaactttcccagacgtcatcacacaacttggaaaagagcgtgtctcctgagttgccatttctgttgtcacgttctgaccagccaacgcttggaaaacaaacatacagttcccgttggaaagactgtggtaatatttcttcacagaagtttgctacctcaggaaaccagttacctctttgtttcttgctggatacatggttttggcaccatgtcaaacctgcctgaggaatcactgtttacctcagaggatgtagccttgctgcttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 304 - DNA, 3530 bp, Artificial Sequence
  3022
gcggccgcacgcgtcacctcattaactcccaggcactaagcttagatcacctttctgtggtgacctttttagctcccttccctttctccaagttatcttccaggggaaggagctaggcctggtcttaggggacaggagtgagccccttggggaccagggctgggccctttggctgccatctggcagtacagtctggagcctcccaagcccctgctgtgaggcctctggggtgaaagtgtctgtcaggctgtgaggtgggtctgtgcccagttcactctgactatccagagacttgggctgttggcctggctcggagaacgggttctgctgccctgggcacaatgcagagcaaagaggaaagaaaccttttccaaagcagaggccaggaggaagcacacagaggcctctttgctttggaaccgaagcctttcaggtctgttttctttaaatatcctgctacaggaaagagaagcccaaatccagacattcctaaaacattcaggtggctttaaagcagcagtttgtttgatcttcaccccaccctgtttctgctcactggggtctctgggacctactcctgcctggagcttggttggaaggtccacacccttccaagttcactcacatagccgatgtaccgatggggcctgagacctgattggaacttgctttttctactttagtctgtttttgttttcgtctgccgtgctgaagatcaaactcttggccgtgtgcatcctaggcgctcactaccactgagtctcagcccctgcccaggttttgtttggtttggtttgaagtcacttttctttgatccccagctgtaatggcatggctgaccacacccttttcctggaaagtctttcccttgacctctggggtcagacacacaatgacttctgactcagtgctctgcctcactactgatcactagacctaaagtcccatcatgaggcacctgagggtctccatcacttcactggtctttaacccagaggactgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 305 - DNA, 3226 bp, Artificial Sequence
  3023
gcggccgcacgcgtggtaatgtagcccatatgtttacagggtaggctcgataaggacgatagatacatatacatctactgtgttacctggttctaggacccacttcagtataggaacaagactaaacagaaattgggccgcatcccattgcacacttccttagctctcatctcctctactccgagacacggagtgctttccacagcaaccacgtaggtgggagctggagtcatttgaggtcttagggccaaggcggtgcttcgcctcaaggctatgcagtttccaagtccagacatctggattttagggtctataatggaaactcagtcggggtcatggcctctcctgggaagagtctccagaattttgtaacaggactttctcttagagatcagtgtgttgtggcgacatgggacaatgtccaggcttctgctgccagatgttgggattgttgtgatccatggctttctcccaaaccaaatcatccgccccggagtttccataaacctttctcaaggggtgtgagctaccagaaagatcatggtgtgtcctgggtgctggcctttgagaacccacctagccctctccagcctctccctcaggctggaggctggaggaagattatttttgtacttgagtaactgcgtcaaccttaggagtaataacttggctatgactctatttatttattcacaaagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 306 - DNA, 3266 bp, Artificial Sequence
  3024
gcggccgcacgcgtccccaggaaagacgtcacaaagtctgtgaataccacatggaatgtgtttagcgtgttccttgttgaccctctgagattcttgaagagcatcccccagtgatctaagttcctcacagcgggtcccacctcctggaggttccaggaccttccagtacatcctggggacaatgtctttagcagggaggtcttggggggacaactaaggtctcaatgataacaccacccttggattaaatacgcaactagcccacctgggcttggtcactgagccctgccccagtcaagacaaaggactaatgtctcccagagggcttcaggagcagcccgcgaagacggacaggcagggcggcaaagcgagcacagcgcctcacatccggaaaattattagacttgtatactctagcaaattctttccagtccacttttagcctggcactgctcacaccactgactttcaggcttgagcagggacatgagccaatgaaaacgaactgtaactcatggacgcagggataagagctctttgggggcggagccaatgaaaaggaactgtaattcctggatggagggatgggagctctctggggggcgcaccgctgtgatgcacacgtggtgagtgcctgggaattggtttcacatgcattttgcctgtgtgaaatacagacggtgaggttttaggtagcagaacacagctttctctcacttcctggttcattcaccgaagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 307 - DNA, 2916 bp, Artificial Sequence
  3025
gcggccgcacgcgtccccacaaccagaagcatgtctcccagaggccaggacgcatcgtggagctggagtcctggagccagaatgaaggagagtccccaagcctgggatgtcacatggcccagccttcaagcaaacatgtaacacccacttgggacttaggaatcattaactggctctgtggcttgtaaaataaataaataaataaataaaccttcctatttgtttaacctctggagttttcagtttcctcttctcaatgaaaatgagccaaccttcccacttttttttttttaagcaggggacattgaaacataccgttcttcctctctgcaccaaagaagatcaggaagtgactttttcccattatgaaatctcagtgatggcccagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 308 - DNA, 2872 bp, Artificial Sequence
  3026
gcggccgcacgcgtgttgcgtctgtcagggacagctctggatccccagagccagatcgtgctctgtagctcccttaggagcaactatcaacagatccatgaccaagagggccccaagattcaaagactgttccagtctactctggatttttccagctgtttttcttggccagaggatcacacccatcgggatgcaaaccgagagcaggaagcaagcggaacagtaaagtcagatgaaccagaggagaggcagatgtcacggacacgaggacggtagcttcgagcagcccaaacccttgcaagagaacacccagaggggtatcttttcaagtgcaggttgtgctgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 309 - DNA, 2868 bp, Artificial Sequence
  3027
gcggccgcacgcgtagggagacacacacagacacacacacacagagagagagagagagagagagagacagacagacagacagacagactgactgactgactgactgagggagcagctggagctcaagccccagctcatgtggaagtatccaagctgctgttcctcgtttggttttggcatgaagcactgtagtgtagtagtggaaagaatggaagcgatgcactcttctgttacatctaaccactacattaaaaatggatatcctgatacctgacccgaggcttgacacaaaacagactcactttacaagcactgcaggaaatctcagaaaagtggagagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 310 - DNA, 2737 bp, Artificial Sequence
  3028
gcggccgcacgcgttcggtccgcagaggttccctctggggtcaagccctccaggccgatgtcgctgtcctgcgcgtcctgcatgatgtgttcgctccggacgccctgggtccagcagagggaccggcagaggcgggaggaaggttgagcccagctgcctgcaccgcgctgctccgcccccggcgctctagtcctggggtcccccagttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 311 - DNA, 3168 bp, Artificial Sequence
  3029
gcggccgcacgcgtctggtacatctgtgttactgctatgtgaatgagccctgtctggctgtggcatctgcagagctcagctactgcctgtctgaaagttcttaatcatttttatttttaggttgtgttgttttgttttgttttgtttttgttacacagttttgggggaggtaccatgtgctagaactacttctaagaaaataattaaagacatagtttctctggacagaaatttgatcctattctttgtgtttgatatgtttttatttagttcacgaataataatggatcctggaagcatgtatctaagtagattgaaaggttcgaaaatcaaattttggaaacgatcgtttacctcttccttccacagaagaaaggctactgtcttgaggacagctaagtgaccacatgggcttgattactgaccacagagccaacaactgcttgttttggctgcagctacttctattttagctttgacagtacaccccagagacaaacttaaaaaagttagtgtgggaactgaaaggccacagtttctcattgtttgctctcacccattgagccctaagtcagggtgtatgaaatcacttcacagtggtcagcacagcaaatggacaaggaaagctctggtgggggggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 312 - DNA, 3035 bp, Artificial Sequence
  3030
gcggccgcacgcgttgagaggagaggagaaggaggggtggggaggcaccagaattcctctctgcgcttctggaagcacattcctaccgtcgttatgagctgactggggatttgggaattgactgccagcatccttggatctctctcttcagcttggccactattctgaccctcgtctccccggtggattctttctggtccctgtgaaacagaagggctgtggacctagcccctcctatagcaggcctcctggattacttcctccatctgttctgcctcccaccctcgggtcaagacgtcatcgtcctcagatcatcatttggtccaaggatttctccgtgatgctcacaattgtttactttcctctgtgctcctcttctggccattccccggggtcagctttggactctctggggacaaacccttcccttgtcatcctgtgcttcccacacccacgaggtcaccgtttcatggactaaatggataagtgacaaggacaatgaagaggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 313 - DNA, 3168 bp, Artificial Sequence
  3031
gcggccgcacgcgtggtgtcctgtgggtgccttgagggtaagaggctcaagaaatcttcaaagtcagactccattcaagagctgaactaatgttgcctgccactagcgacattaaccctcagggagggttggacaggatctggggaagctgcaggtgcagagtgcactagaatttgaaccccaggatacagacaagaagctgcctaaaggcagagagccctgggtaccgtggtcccaggaggccaaagccccggaggtcacagagctgagctcattcttcctctccagctgcagatgttgtaagggaaaaacaacaaaacaaacaggaagttctgaggatggtttcccacgtgtttctctccatgtttctctccagtcactgcctcgtcacccaaaccagttttctcctctcagcctcttgtgctcccagatcaggcctccctccctcagcccagatgtccccaacgggggtggggggtggtttatgcttcgcttctaggatgcctgcatcttagaaaggcaaggtggcaggctgcacaggcaactgcattatcatttcttaatgtcatttttttctgatccgtatgatgggggaaatgtgctgggtgtggctcactcctgtaatcgtagcactcaagagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 314 - DNA, 2966 bp, Artificial Sequence
  3032
gcggccgcacgcgtctctcatgtgggattgctcacagttagctcaaaccttactctcagacttcagaatccctcttggacagagcaggaaggaagaccatagtatgtccagctgtacaaatggaacacagacttctgatttcccatcatacggctaactatagaagcagaggacaccacactgcgtgacactgaagcttctggcctttctcccatgacccctgcttccacatgtcataacagtcccacagctggaaactagatggtcttcagatggctctctctacccagagaacatcatgctgcacatttccaggagaaaaaaccagaagtatgacaaagaaaaacgacaggagattccttcagagtacagactcctcttagaacaatgaagatgtttgactaaagcactccaagttacttgtgcaatgtgttgttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 315 - DNA, 2902 bp, Artificial Sequence
  3033
gcggccgcacgcgtttagttttcatataaagaaacacatttgctttctgctctaatggttctcttaggaatcctgaagttctcaggagaatcaaagcacagatgtgagacagcaagttatactttcattcaggagagaaaaacttgacagccaagagaaaaggaagctgctctggattcctgtctcctgcagctgggaagttttgcaaaggtccccagggaggaacagggccaccaaaggctgagcaagagtgactcgggaacattctgagtcaagcagggactggggaccagaatgcaagataaggcatggaattagcggaggccatttcccttgcttctcagggacctcctaaaacacatagtccaggagggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 316 - DNA, 3204 bp, Artificial Sequence
  3034
gcggccgcacgcgtcagctgcttttcctgaaggcagcttcagcttttccaaagccagggtgctgctgtggtcagctagtgctgcactaaatatcctcttccaaggggctctgatcctggctccagcccctctggcctctgggactggttttctctatttcctttccttctccaaggttagcttttcagactcaacaacataaatcaagagcctctagggaggtgaacagaactggccggagaggaagcactgcttcagtgggggaaggggaatgtcctggactagcaggccccagtaggggtggagtgtgggggtatggtgcatactcagatgtctccttggaaggagtgggtggcaaggattcttccataaactgataagccgggacacagagtcccatcccccatccccaccctgttacactgctataaacagagagggctgaaggcaaaaggaccctgcttgctgctgcagctggtccagtctagggggctcttcagtagaggacagctctcttcttgtcacgtgctttcctctctgaacagagctggttgttttggggcacttgggctcctgtggactaatggggtcaaggaccaggccagacacacactaaggcctggagtccctggggactagtggttccagttcactaacctctgcccttcaaatctggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 317 - DNA, 3020 bp, Artificial Sequence
  3035
gcggccgcacgcgtcgagacctaaacagccgccgtggaggtcatagtcctagtcaggttcctgcgcagaggccctaagctgccgagtgacaagcagaagggtgagtggaggcaatgacagtcatctggcagggaggaggaacgccagactccttggaatgctgtggtggttttctttaaagttgttccccatgggaatcaaggcagtcatcccagggggtggggggaaagggtttaagacttccttcctcagaaaaggacactgctactgtactgcagctgcaagggaatgcctgctatgttgtggttgatgctgacccaggatggaatgcagatgaaggatgcttttaggaaacaagtctgcttggaatgctgggtggcaatccttagcttttggtcgagtggaagcctggcctcacttgtcaacaatgaaaactaggttggttagaacctaatagactccctggctcctgccccccatgctcactgttagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 318 - DNA, 3210 bp, Artificial Sequence
  3036
gcggccgcacgcgtgggtctccctagcccaacccaaaagagaaaggatgcaggaaggatgtggagagggaggcaggaatcgggccagaagcaccctcaagtcctctcctcccccctcctccctcacttccacttgaggagtcctctcttttctctctccctctcccctcctccttccttcccagtcctctctcccctcccccttcccttttgtcctccccccttcagcaccccctccaattttctctcctacttctctctccccttcccctcccccctcccccctcctccctgttctttctccctgcccaggcccactgcctcccctagcccctgctcccagaaagccctggaaaggcagctttctttgagacaggaaggtgtcctcaagtctcaggaaggaaaaacagtcgagctgaacccaagaccgtctccaaggggctggggctggctccgggccagggctgacatcacctgggaaccactgcctctgcagctgcagcccgcctcctggggggatgcttctgctatttaaaaaataataataatactaaaaaaacttttccagtctggtgtttttaaatgtgctttatatagtgggccctggggtgtgggagattcaatcccctcccgtttgtcctcacagcccgggtttctcacaccgcactgggcagccttccgagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 319 - DNA, 3185 bp, Artificial Sequence
  3037
gcggccgcacgcgtagtaacttcatttccctctctaaatttgggttccttctatatctggccaatggtcattttcagaaaagaagggcagtcctagctgcaggagcactttaaggagttgtttattatgagtaacagatgtagtaggagaggtgagactgagtacagacctttctagacattttctacaagaaatcctggcagctgtaattcccttaggtggctggtcatcatcagaaggcctctgagagatgatcaagaggtcaattttgacagaaaatggtaaaaatttgtggattgtccgtattacttcccattcctgacaactgttccttcttaaaggccagttctgaaaggtcagagtgtggaaatacatgcgccagaaaaaggcttgcagcagggctttttaccataaatgctgcaaattagtgcttcaaggtcccagtgagaaaagaccttttaactttctctgctgttgacatcaggataataactgtgggaagagtggaagggcagatcctgtttaaaaaagaaaattggaccttcagggagaaaaggaaggatcttcgtatcctttcccacaaatgcaagacaattgtcctaggaaaacacagcctatgatcacagcacagcaaggcaagttcccagaacatctgagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 320 - DNA, 3091 bp, Artificial Sequence
  3038
gcggccgcacgcgtgccgtatctcatttttagacatttaagttacttccaacttttcctgcttatcagttacgtcagcatggctatttttatacctagatggcctgtgttcctgactgcttggaagtagacttactgggtcaaaggggatgccagtgtgattttcagaaaacgatgcccgtttctgttcacagctggtttctataaagcatgggaacggcgcaggcactatttatgtgccctgctgaattctcagctccctgcttcatctgaccttccgccactactcagaatcggctctgttcttctcctgggctcccgatgggagccaagctggacttgtgtcagtgtattaagaagtgctcgttatagctcattgcccatgggatgtcgactgctgctgatttctcagggctggagatgacacattttctcacattcttcaaaagtcttaaggttcagcaggagagaaggaaggtccgagccaaggagagctgcggccataccgacagggagggcactctctctttctctagctctccccccccccccttgaaaagggggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 321 - DNA, 3250 bp, Artificial Sequence
  3039
gcggccgcacgcgtgcagggcatggtggagcatgcttgcaatcttccaacttaggaggcaaaagcaagagggtcatcagaagttcaagtccattctcacctacgtaacaaactttatgcctaggctgggttatgtgagaccttatctcaaaatagccactcatgtaaacaacaaagaaaaaccccaactgtttagggaactctcacgcttcaggagccataccgaaataggaagaaaatccttgtggcacagtgtttctggacagatgtgagaggaatcagttgagactaagctgacctttagtttagttgcagctggagctcagattcatcgcctgaatattatttaactagtttcctggcgaagagcttccatccaagaactaaacatgttctgcgctgagcatgaaagacccaacctttgattaatctttcctgttcaaacttttcaccactgcggagcacttcccaaacacaagggttcttggaaaagagactgcacacttggttaaggagccagagaggagcaaactgcaaatgcttgaaacagcaccacccaagtcccagctccctctcagactccaggatttggaatgctaatctgaggacctccttccaccatggatgacaggcagaaacagaaacctaatacagtcactcactgaggtagtaggacacagcatggttttttttttttttcccagcactttccttaactctttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 322 - DNA, 3028 bp, Artificial Sequence
  3040
gcggccgcacgcgttcatgaggaacaactgaaaactgtttgtttccctgaatccatgacaacaggaacttagtccaaaactcagccatgaatgttggtaacgtgggcactgcagcgacctgaaagaattcgggcccggcttgcatgttgaacacagagttgccagtggcatacttttttggtagagaggaatagaaaaccctggcttcctctgagaattgaatgcctcctcccaatgcagtccaaattccactgagaaccttaaccttataagggaaggcagcttttgagtcacaggcctttgctgtttctttctcactggctggcctggaatgagcctctgctaaaaatgttccaagcagctattgacctagacatttctctcttcttttctagcaacttatatgtgtgtgctgaaagaatgctgcacgttcctgtgacctcactcacccctctgagtgccttcttggaaaggagatgtaggtggagggtttcccagagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 323 - DNA, 3066 bp, Artificial Sequence
  3041
gcggccgcacgcgttcctatgagaaccacagtgtcatcccatctaatgactgacagcatccatccatgattcctggagaatgggcctctgggtgggactgaggcagcatctctttcatgtgtgagaatggactcaatgacctgccaaggtctttttctggtccatggctctgggtacagctgcaaaaataaacttatggttacagcaatggaaacaggcctgtaaatacaggtcgccaggacgcaactctgtgacacaggcaatgacaaattcccagtgtgcatttgcgtgacttgcacattctctctgggaaagcctgccctgggatcctacaaacagaaatgtgggaatacttttgtccagtgagtataatgccacaggccagacttgatcttccctccatgttccctcgacattttggccagagaccaatatatctttagtaattcctcaagacccatgggaactgaatcaagggaggctctccacatcacacacacacacactcacacacacacacacacacacacacacacagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 324 - DNA, 3017 bp, Artificial Sequence
  3042
gcggccgcacgcgtccagggcggtcccaggcctcagagctccaagggacgggaagtacccagtgaagcaagggacagccctggtggaataactccttcacagctccatcccagaagtcagcggccacccagggcagctggtacaccacagtgacgaacctgattgccagtcagcctggcagccacaagaatggggtaattctacaaggaccagggccagagctgtctgtaaggggttaaaaaaaaaaaaaaaaaaaaggacactcctcggtccccaggagttaaagggaatcctggcaagccacccaggagaactctctggaggcatgtttgacttttaaattccaaactctagctgccccagtgcttcagagagatgttgccaaacgagttcaaagagacatgcatgggtcaaacagtaaccactctacaagagaagctgctttgtgtgttctgaggtagctgataacatggacacaggaatactctgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 325 - DNA, 2998 bp, Artificial Sequence
  3043
gcggccgcacgcgtcatcgcacagcttagcctgtggcccccggagtttggacagtgtccctgagagagaagttgaggtgctggtaccccgtccagcctgcctgtccggctgtcctgctcctgccaacccaggcctactcccaaccccccaccaccacaggcaggcaacttggccctgggatcggtacagtccagtacacatgtcttgtcaatcacaacttgctcaaaatagttgctggctgcattttccctcccccaactgtgttactcctagaactaattatagtacaaatttctgccttccatgtcccttttactgcatggaccttttagtcaggactcagtatcagatctctgggttttttaactaagtgatctatcaggcaccatgccttcctccaaggatcatgaacctaactgcttttggccaaagtccatcggaaagtgacatcaacagagacttcagtctcgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 326 - DNA, 3061 bp, Artificial Sequence
  3044
gcggccgcacgcgtcctctcctcctctttgtttttcttctgctggcacagggctgggagagccagttaacgcagatggtagtgcagagagttctcatgaccccggttttattagctggggaccaggactttctaaatgtgcccgtgtttgattgtatactcatgttgcctgatttagccacattacttctgattgcttcttagtgattttcccactgaaatttctttcctattggttttgtagaggtatagttcactcccatctctatctgaatggcattctccaacccgagaagcatgctgggaacgtgggccagggaaaatgcgctcccccatgccaccatgcccgcctgaagcctgtggtttcacagaggattcttcggtaggcgctgcttgagttgtagtctgatgacggtgacgcttatgttccggcttccctacagtaactcttcttggctgattattgctagagaatctcattggaggaaagaggaaaagacggaagctgagacctgtttgtgcttcccctgaacgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 327 - DNA, 2910 bp, Artificial Sequence
  3045
gcggccgcacgcgttgtgtcaggctggcaagttagtgaacctcacctcccggtccctgctaccctggcttccagtgtcctgcggcttctgccagcctttgcatttttctctttttctcattgcgtggcccccttgtctttaaaaggctaaactgctctgtactaaatttggtcacgcagcgctccaagattccctggaatgtcctcaagtttcaaacagctctgaccgtgaggcaggcccgccccctggcttggggattggcttctcctctgtggctgggcagctgtcaggttttattggttgctggttagaccaagcagggtccactagcagggaggctgctgtgtcccccggagcacctgtagtacagcagggcccaaagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 328 - DNA, 2931 bp, Artificial Sequence
  3046
gcggccgcacgcgtaggaaggctggggttgtcttaacataaacacagcttaaaggaactattctcaaatctctctcctttctgaccagctacctaagtcatcaagacaaactcttcaactggcagaaagctggcctagcctcactatgcctcccagcacactgccttctggggcagcaagtgcctgggaacatcgtagaagcacattcccaggacctgctgggctaaggcttcacctcacatggtcaccatcaggccgggttcaggcccctcggggctctgcttttagcagcaatgggaaagaggcacagggtaagagagtcagagggcgataggcaggtctgcaaagcaaacactcagaaaattagaaatagctcaagaaacaaatgccctgagaaagtatgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 329 - DNA, 3205 bp, Artificial Sequence
  3047
gcggccgcacgcgtcattgtgaaacacaccacacattgcatggcagccccagcagagtcctaggtattccccaaggaccaaatgtactaatgtttttctgcagagaaacataggacaactcacacgctagagaaaaaaattacaaaggttacaaatagctttctctcgggatttgctgccagaccagttgagagcatataaggtcaggttcttgctctgcaaggtcccaagttccaagttttgagaggtttgggattttgcaattgggggtaaaagggtattgacccactgtacaaatgacttttccctggtattcccattgggtcctagcacttacttcaaagaccttacacattctcgggggggggggccctctgcaggggcaacaagcaccagtttgttactccaacagcagaagccatgggaaaattcctcagagcagcaaagctgccccttccagctctctgtcacagagagtgctgccctttcctgctcctaggacgcggcacttatggccatgatgacatcatcatttaagatagtcactaactgacccacactgttaccatcctgacccactcctcaaccatcctagtaaacctctcttgataatggattaggcaaagagagtgtactccgctgttacccagaaacctcagggagagagagatcaaatgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 330 - DNA, 2985 bp, Artificial Sequence
  3048
gcggccgcacgcgtttttcttccaaacggctatgtgtctgtacatggactaacttatatgatcacctgtccagactcacaagccttcagccctccccagcctccctacggctgccacactggccaggaggggctcttctgggcaatctggccctggtcccggcagcatgacgctgagcaaggcaggggtgtggagagctagtctgtgtacccttcaagggcagccagagacaggaggtggagcctcagctggccagcaggtcccacaggccactgttgcagggcagcaggtcacatgctaggcgtgctttgcgatcccggacggccttcagggctgggctgtgttgtaacaggagggagcaaatgtcctcgtgacccttctccgcagcctgggggggggggttgtgggggggagggagggagagagagagagagagagagagagagagagagagaggagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 331 - DNA, 3059 bp, Artificial Sequence
  3049
gcggccgcacgcgtaaattctgtgttgtagagtttattttccttcagtgtgatagtcagggtctgagcctgcctcacagtgagcatggagggcagttacagccagcatggacgacctctgtcctgactggaatgtggctctggaaggttttttttgtttgtttgtttttttggcttctgcttctatgccacgactcttgtacccagtgtagagaacttggtgtttcccctgggggtgctacacatcacccctctcctagattctggcctcgtccccttctcaaggtcatcagcactagggcaggcttctatttaaccttggacttaattctagaagccatgcctctcccttcttgacttgttgccattaaaggcactttgcaaagcttcttcggttccctggcaatcttgcagcagcctgggggagcccttgtcttagctgctcctgccttctgccctcctttctctaaagttttctttctcagcgcccttctctctgagacaaggctgctctagggcagtcctcccctcgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 332 - DNA, 3035 bp, Artificial Sequence
  3050
gcggccgcacgcgtatttttacttgattgttttgcctactgaatccaaccagtaaaagtaaatattctcccttttccccgctggagagaggcagatagaaccagttctagtctgggaactacttcctggttgcacaggagcctgctagagcctcctcccccgactcagctgggcacaggaaggtggcttcgtccctaaaaggtagcgcccgaggtctggtgaggacacagtgagctggttggccatgtgaagtgagccagaggaggagaaggttgaggtcgctggtccttagctctgacctgctgttcccggtttccttcagccaattctcccttcgattatttttagcatggagcagcggacaaaggcagtgggccagcaagggaagatagatttctatcttaaccaggccacttacacgggacctctgtcttctagtctgtagagtatagtagatagtcccagcgctttaccctgtcactgttaaaaacactatgacctgcacagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 333 - DNA, 2921 bp, Artificial Sequence
  3051
gcggccgcacgcgtcaatgtaaatagacagtgactatcccatcctgtaggatggtgggaactggccaagtcttttttcttccccttctttcccagtgtttagggtccttcagagagagacactcagctgcccagatctcccaggagcctgctactggctctgtccaaataagctcagtaaacagccccagggtgctctctctagctcgcttgcgctctctctctctctctctctctctctctctctctctctctccccctctctccctgtatccctctccccctccctccctcccttgtcagagtgtgttgcagcttttcaaatgcttagacaaacatttcctgtcctcaggggagtgatctgagctctcctgaggtcctgaccattgcccagagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 334 - DNA, 2920 bp, Artificial Sequence
  3052
gcggccgcacgcgtgagaagaatggcaagtgtgtgagagagggcaaagcagaaaagggccaagcgggtcctcagggagaagccacagccctctccagcctgtgctgtccaggaacaaagctgccctaggcctccccaggggctcactggccggtctctgggtttccccggctaagagctcccggcacaggggaggagccgggagtgggcggggtcgtgaacacgggctggggcggggctagagggggagggctcagccttagtccctttgggtgtctagagggcggggcctaggctgatggagatccgtgaccctagaggatacactctgaaggaggtcagggccacgacagagaaggggaggaggcaggcggctgtgcaaataaaggtttgagctcgggctgggcataaaagtcagggcagagccatctattgcttacatttgcttctggcgtggccaccatggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctgagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctgctcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 335 - DNA, 53 bp, Artificial Sequence
  Beta-Globin Minimal Promoter
gggctgggcataaaagtcagggcagagccatctattgcttacatttgcttctg

SEQ ID NO: 336 - DNA, 68 bp, Artificial Sequence
  minCMV Promoter
gaggtaggcgtgtacggtgggaggcctatataagcagagctcgtttagtgaaccgtcagatcgcctgg

SEQ ID NO: 337 - DNA, 68 bp, Artificial Sequence
  Mutated minCMV Promoter (SacI RE site removed)
gaggtaggcgtgtacggtgggaggcctatataagcagagctggtttagtgaaccgtcagatcgcctgg

SEQ ID NO: 338 - DNA, 120 bp, Artificial Sequence
  minRho Promoter
gattcagccgggagcttagggaggggaggtcacttcataagggcctggggggggagttggagccacgagtcgtccagccggagccccgtgtggctgagctccggcctcagaagcatcccc

SEQ ID NO: 339 - DNA, 120 bp, Artificial Sequence
  Mutated minRho* Promoter (SacI RE site removed)
gattcagccgggagcttagggaggggaggtcacttcataagggcttggggggggagttggagccacgagtcgtccagccggagccccgtgtggctgtgctccggcctcagaagcatcccc

SEQ ID NO: 340 - DNA, 867 bp, Artificial Sequence
  Hsp68 minimal Promoter (proHsp68)
caggaacatccaaactgagcagccggggtcccccccaccccccaccccgccccacgcggcaactttgagcctgtgctgggacagagcctctagttcctaaattagtccatgaggtcagaggcagcactgccattgtaacgcgattggagaggatcacgtcaccggacacgcccccaggcatctccctgggtctcctaaacttggcggggagaagttttagcccttaagttttagcctttaacccccatattcagaactgtgcgagttggcgaaaccccacaaatcacaacaaactgtacacaacaccgagctagaggtgatctttcttgtccattccacacaggccttagtaatgcgtcgccatagcaacagtgtcactagtagcaccagcacttccccacaccctccccctcaggaatccgtactctccagtgaaccccagaaacctctggagagttctggacaagggcggaacccacaactccgattactcaagggaggcggggaagctccaccagacgcgaaactgctggaagattcctggccccaaggcctcctccggctcgctgattggcccagcggagagtgggcggggccggtgaagactccttaaaggcgcagggcggcgagcaggtcaccagacgctgacagctactcagaaccaaatctggttccatccagagacaagcgaagacaagagaagcagagcgagcggcgcgttcccgatcctcggccaggaccagccttccccagagcatccctgccgcggagcgcaaccttcccaggagcatccctgccgcggagcgcaactttccccggagcatccacgccgcggagcgcagccttccagaagcagagcgcggcgcc

SEQ ID NO: 341 - DNA, 720 bp, Artificial Sequence
  SYFP2
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaa

SEQ ID NO: 342 - DNA, 720 bp, Artificial Sequence
  EGFP
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 343 - DNA, 1299 bp, Artificial Sequence
  Optimized Flp recombinase (FlpO)
atggctcctaagaagaagaggaaggtgatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatctga

SEQ ID NO: 344 - DNA, 1056 bp, Artificial Sequence
  Improved Cre recombinase (iCre)
atggtgcccaagaagaagaggaaagtctccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggactaa

SEQ ID NO: 345 - DNA, 50 bp, Artificial Sequence
  SP10 insulator (SP10ins)
gaagctacccctaacacactattctacacacagaaaatgctcttcactag

SEQ ID NO: 346 - DNA, 150 bp, Artificial Sequence
  3xSP10ins
gaagctacccctaacacactattctacacacagaaaatgctcttcactaggaagctacccctaacacactattctacacacagaaaatgctcttcactaggaagctacccctaacacactattctacacacagaaaatgctcttcactag

SEQ ID NO: 347 - DNA, 246 bp, Artificial Sequence
  WPRE3
ataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtgg

SEQ ID NO: 348 - DNA, 609 bp, Artificial Sequence
  WPRE
gcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccg

SEQ ID NO: 349 - DNA, 204 bp, Artificial Sequence
  BGHpA
cgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatg

SEQ ID NO: 350 - DNA, 479 bp, Artificial Sequence
  HGHpA
acgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 351 - DNA, 78 bp, Artificial Sequence
  P2A
ggcagcggcgccaccaacttcagcctgctgaagcaggccggcgacgtggaggagaaccccggccccggagctagcgga

SEQ ID NO: 352 - protein, 21 aa, Artificial Sequence
  T2A
  MISC_FEATURE (1)..(3): (GlySerGly) residues can be added to the 5' end of the peptide to improve cleavage efficiency
GSGEGRGSLLTCGDVEENPGP

SEQ ID NO: 353 - protein, 24 aa, Artificial Sequence
  E2A
  MISC_FEATURE (1)..(3): (GlySerGly) residues can be added to the 5' end of the peptide to improve cleavage efficiency
GSGQCTNYALLKLAGDVESNPGPP

SEQ ID NO: 354 - protein, 25 aa, Artificial Sequence
  F2A
  MISC_FEATURE (1)..(3): (GlySerGly) residues can be added to the 5' end of the peptide to improve cleavage efficiency
GSGVKQTLNFDLLKLAGDVESNPGP

SEQ ID NO: 355 - protein, 743 aa, Artificial Sequence
  PHP.eB capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 356 - protein, 736 aa, Adeno-associated virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 357 - DNA, 747 bp, Artificial Sequence
  tet-Transactivator version 2 (tTA2)
atgtctagactggacaagagcaaagtcataaactctgctctggaattactcaatgaagtcggtatcgaaggcctgacgacaaggaaactcgctcaaaagctgggagttgagcagcctaccctgtactggcacgtgaagaacaagcgggccctgctcgatgccctggcaatcgagatgctggacaggcatcatacccacttctgccccctggaaggcgagtcatggcaagactttctgcggaacaacgccaagtcattccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggatcaggagcatcaagtagcaaaagaggaaagagagacacctaccaccgattctatgcccccacttctgagacaagcaattgagctgttcgaccatcagggagccgaacctgccttccttttcggcctggaactaatcatatgtggcctggagaaacagctaaagtgcgaaagcggcgggccggccgacgcccttgacgattttgacttagacatgctcccagccgatgcccttgacgactttgaccttgatatgctgcctgctgacgctcttgacgattttgaccttgacatgctccccgggtaa

SEQ ID NO: 358 - DNA, 130 bp, Artificial Sequence
  Exemplary Plasmid Backbone 1 - Left ITR
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 359 - DNA, 141 bp, Artificial Sequence
  Exemplary Plasmid Backbone 1- Right ITR
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 360 - DNA, 146 bp, Artificial Sequence
  Exemplary Plasmid Backbone 2- Left ITR
catgtcctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 361 - DNA, 149 bp, Artificial Sequence
  Exemplary Plasmid Backbone 2 -Right ITR
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctg

SEQ ID NO: 362 - protein, 189 aa, Artificial Sequence
  GTPase HRas
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 363 - DNA, 1353 bp, Artificial Sequence
  GCaMP6m
atgggttctcatcatcatcatcatcatggtatggctagcatgactggtggacagcaaatgggtcgggatctgtacgacgatgacgataaggatctcgccaccatggtcgactcatcacgtcgtaagtggaataagacaggtcacgcagtcagagctataggtcggctgagctcactcgagaacgtctatatcaaggccgacaagcagaagaacggcatcaaggcgaacttcaagatccgccacaacatcgaggacggcggcgtgcagctcgcctaccactaccagcagaacacccccatcggcgacggccccgtgctgctgcccgacaaccactacctgagcgtgcagtccaaactttcgaaagaccccaacgagaagcgcgatcacatggtcctgctggagttcgtgaccgccgccgggatcactctcggcatggacgagctgtacaagggcggtaccggagggagcatggtgagcaagggcgaggagctgttcaccggggtggtgcccatcctggtcgagctggacggcgacgtaaacggccacaagttcagcgtgtccggcgagggtgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacatccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacctgccggaccaactgactgaagagcagatcgcagaatttaaagaggctttctccctatttgacaaggacggggatgggacaataacaaccaaggagctggggacggtgatgcggtctctggggcagaaccccacagaagcagagctgcaggacatgatcaatgaagtagatgccgacggtgacggcacaatcgacttccctgagttcctgacaatgatggcaagaaaagggagctacagggacacggaagaagaaattagagaagcgttcggtgtgtttgataaggatggcaatggctacatcagtgcagcagagcttcgccacgtgatgacaaaccttggagagaagttaacagatgaagaggttgatgaaatgatcagggaagcagacatcgatggggatggtcaggtaaactacgaagagtttgtacaaatgatgacagcgaagtga

SEQ ID NO: 364 - DNA, 1353 bp, Artificial Sequence
  GCaMP6s
atgggttctcatcatcatcatcatcatggtatggctagcatgactggtggacagcaaatgggtcgggatctgtacgacgatgacgataaggatctcgccaccatggtcgactcatcacgtcgtaagtggaataagacaggtcacgcagtcagagctataggtcggctgagctcactcgagaacgtctatatcaaggccgacaagcagaagaacggcatcaaggcgaacttccacatccgccacaacatcgaggacggcggcgtgcagctcgcctaccactaccagcagaacacccccatcggcgacggccccgtgctgctgcccgacaaccactacctgagcgtgcagtccaaactttcgaaagaccccaacgagaagcgcgatcacatggtcctgctggagttcgtgaccgccgccgggatcactctcggcatggacgagctgtacaagggcggtaccggagggagcatggtgagcaagggcgaggagctgttcaccggggtggtgcccatcctggtcgagctggacggcgacgtaaacggccacaagttcagcgtgtccggcgagggtgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacatccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacctgccggaccaactgactgaagagcagatcgcagaatttaaagaggctttctccctatttgacaaggacggggatgggacaataacaaccaaggagctggggacggtgatgcggtctctggggcagaaccccacagaagcagagctgcaggacatgatcaatgaagtagatgccgacggtgacggcacaatcgacttccctgagttcctgacaatgatggcaagaaaaatgaaatacagggacacggaagaagaaattagagaagcgttcggtgtgtttgataaggatggcaatggctacatcagtgcagcagagcttcgccacgtgatgacaaaccttggagagaagttaacagatgaagaggttgatgaaatgatcagggaagcagacatcgatggggatggtcaggtaaactacgaagagtttgtacaaatgatgacagcgaagtga

SEQ ID NO: 365 - DNA, 1353 bp, Artificial Sequence
  GCaMP6f
atgggttctcatcatcatcatcatcatggtatggctagcatgactggtggacagcaaatgggtcgggatctgtacgacgatgacgataaggatctcgccaccatggtcgactcatcacgtcgtaagtggaataagacaggtcacgcagtcagagctataggtcggctgagctcactcgagaacgtctatatcaaggccgacaagcagaagaacggcatcaaggcgaacttcaagatccgccacaacatcgaggacggcggcgtgcagctcgcctaccactaccagcagaacacccccatcggcgacggccccgtgctgctgcccgacaaccactacctgagcgtgcagtccaaactttcgaaagaccccaacgagaagcgcgatcacatggtcctgctggagttcgtgaccgccgccgggatcactctcggcatggacgagctgtacaagggcggtaccggagggagcatggtgagcaagggcgaggagctgttcaccggggtggtgcccatcctggtcgagctggacggcgacgtaaacggccacaagttcagcgtgtccggcgagggtgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacatccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaacctgccggaccaactgactgaagagcagatcgcagaatttaaagaggaattctccctatttgacaaggacggggatgggacaataacaaccaaggagctggggacggtgatgcggtctctggggcagaaccccacagaagcagagctgcaggacatgatcaatgaagtagatgccgacggtgacggcacaatcgacttccctgagttcctgacaatgatggcaagaaaaatgaaatacagggacacggaagaagaaattagagaagcgttcggtgtgtttgataaggatggcaatggctacatcagtgcagcagagcttcgccacgtgatgacaaaccttggagagaagttaacagatgaagaggttgatgaaatgatcagggaagcagacatcgatggggatggtcaggtaaactacgaagagtttgtacaaatgatgacagcgaagtga

SEQ ID NO: 366 - DNA, 22 bp, Artificial Sequence
  Forward primer 5'
actccatcactaggggttcctg

SEQ ID NO: 367 - DNA, 20 bp, Artificial Sequence
  Reverse primer 5'
ggacacgctgaacttgtggc

SEQ ID NO: 368 - DNA, 17 bp, Artificial Sequence
  Reverse primer 5'
acgtcgccgtccagctc

SEQ ID NO: 369 - DNA, 623 bp, Artificial Sequence
  eHGT_641m
aagcatgaatggcctctcaggatggaaggggggcggggagagaagaaagccggtcagaggcagcagttgcttttaagaatatgtaagatttctagtttctgaggtgctgtgttatagcagctttaagcaagacctaacaatttgttaaatacttcatctccaaacagtggtgggtactacagtttcatgagcagcagataatagattctgtttattcgccaacaataccgacactgtttcgccccggactgcaagtggctgagccatctggctcctatctccacagtaaaacattgtccgtgacacaaaaaatgactacatccccaggacaaactagtgtgacctctaaataaagccttcctctgaagctatgatatcacactgcacaggggacaccagcacaattgaatctggtcaccaaaagcccaagtgagataggactatgtaaatgggattttataggagacgttttgtcctctgtgcaaaccatcgagatccgtccacagcactgaaacatctttttcattcaccctgaggacaacagtgtgcttctttctggggggttggcagtcctctttctccggccccaggccgaggaagcacacatccgtgtcccagaggtg

SEQ ID NO: 370 - DNA, 608 bp, Artificial Sequence
  3xCore_eHGT_410m
cactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcaacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcaacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtca

SEQ ID NO: 371 - DNA, 750 bp, Artificial Sequence
  3xCore2_eHGT_390m
gaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggaggaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggaggaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggag

SEQ ID NO: 372 - DNA, 955 bp, Artificial Sequence
  3xCore_eHGT_373m
gtttggggtaagggatggaagtggaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctgatgtttggggtaagggatggaagtggaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctgatgtttggggtaagggatggaagtggaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctg

SEQ ID NO: 373 - DNA, 1973 bp, Artificial Sequence
  CN2845
gcggccgcacgcgtaagcatgaatggcctctcaggatggaaggggggcggggagagaagaaagccggtcagaggcagcagttgcttttaagaatatgtaagatttctagtttctgaggtgctgtgttatagcagctttaagcaagacctaacaatttgttaaatacttcatctccaaacagtggtgggtactacagtttcatgagcagcagataatagattctgtttattcgccaacaataccgacactgtttcgccccggactgcaagtggctgagccatctggctcctatctccacagtaaaacattgtccgtgacacaaaaaatgactacatccccaggacaaactagtgtgacctctaaataaagccttcctctgaagctatgatatcacactgcacaggggacaccagcacaattgaatctggtcaccaaaagcccaagtgagataggactatgtaaatgggattttataggagacgttttgtcctctgtgcaaaccatcgagatccgtccacagcactgaaacatctttttcattcaccctgaggacaacagtgtgcttctttctggggggttggcagtcctctttctccggccccaggccgaggaagcacacatccgtgtcccagaggtggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgagatctcacgtgcggaccga

SEQ ID NO: 374 - DNA, 1961 bp, Artificial Sequence
  CN2556
gcggccgcacgcgtacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcaacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcaacactcttccctttattctttcttccaggccttttagtgtttgcttaatcagaatattttaatctctaatgtggtgactagatgtaatttatcacattaagcctctcctattttcttctgcttacatgactaacgttattgtgtttttattgcgcttatacaaacaagcctttcctttgttccattgtttcagcaataggtcagagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 375 - DNA, 2102 bp, Artificial Sequence
  CN2558
gcggccgcacgcgtgaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggaggaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggaggaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctgggctccagcctttgtgtggggtgaattgagctgagcggctagctggttggaggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

SEQ ID NO: 376 - DNA, 2309 bp, Artificial Sequence
  CN2560
gcggccgcacgcgtatgtttggggtaagggatggaagtggaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctgatgtttggggtaagggatggaagtggaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctgatgtttggggtaagggatggaagtggaaaaaaaaaaaaaaaaaggaaagaaaaagcaaacaaaagccaaccagccttccagctgctgaaggagctggggcacaacccttgaagagtgcccctgccgggaacagagaggactccagctgcctgcccactgggccagagcgctgccttaaaagaacttttgcataaaaggaaaagaggccaaggctccccttttgctgcaggacacagggccagtgtccacaagagttgagtgtcctggccaaagccaaagctagggatcattgaaaatgcctgggcagctggcatggctggagctcgggctgggcataaaagtcagggcagagccatctattgcttacatttgcttctgggatccagatctttcgaagctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagtcgacggcgcgccgcggccgcgaattcgatatcataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggctcgagagatcttcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcacgtgcggaccgagcggccgc

What is claimed is:

1. An artificial expression construct comprising (i) an enhancer having a sequence of SEQ ID NO: 13, SEQ ID NO: 371, or SEQ ID NO: 72, or a sequence having at least 95% sequence identity to the sequence of SEQ ID NO 13, SEQ ID NO: 371, or SEQ ID NO: 72; (ii) a promoter; and (iii) a heterologous encoding sequence.

2. The artificial expression construct of claim 1, wherein the heterologous encoding sequence encodes a fluorescent protein.

3. The artificial expression construct of claim 1, wherein the heterologous encoding sequence encodes a neurotransmitter.

4. The artificial expression construct of claim 1, wherein the artificial expression construct is encapsidated by an AAV capsid protein that crosses the blood brain barrier.

5. The artificial expression construct of claim 4, wherein the AAV capsid protein comprises AAV9, AAVrh.10, PHP.eB, AAV-BR1, AAV-PHP.S, AAV-PHP.B, or AAV-PPS.

6. The artificial expression construct of claim 1, wherein the artificial expression construct comprises or encodes a skipping element.

7. The artificial expression construct of claim 6, wherein the skipping element comprises a 2A peptide and/or an internal ribosome entry site (IRES).

8. The artificial expression construct of claim 7, wherein the 2A peptide is selected from T2A, P2A, E2A, or F2A.

9. The artificial expression construct of claim 1, wherein the artificial expression construct is within a viral vector.

10. A transgenic cell comprising an artificial expression construct of claim 1.

11. The transgenic cell of claim 10, wherein the transgenic cell is an astrocyte, an oligodendrocyte, a microglial cell, a pericyte, a smooth-muscle cell (SMC), or an endothelial cell.

12. The transgenic cell of claim 10, wherein the transgenic cell is an L1 interlaminar astrocyte.

13. A method for selectively expressing a heterologous encoding sequence within a population of cells in vivo or in vitro, the method comprising providing, in a sufficient dosage and for a sufficient time to a sample or subject comprising the population of cells, an administrable composition comprising an artificial expression construct, wherein the artificial expression construct comprises (i) an enhancer having a sequence of SEQ ID NO: 13, SEQ ID NO: 371, or SEQ ID NO: 72, or a sequence having at least 95% sequence to the sequence of SEQ ID NO 13, SEQ ID NO: 371, or SEQ ID NO: 72; (ii) a promoter; and (iii) the heterologous encoding sequence, thereby selectively expressing the heterologous encoding sequence within the population of cells.

14. The method of claim 13, wherein the heterologous encoding sequence encodes a fluorescent protein or neurotransmitter.

15. The method of claim 13, wherein the providing comprises pipetting to a brain slice.

16. The method of claim 15, wherein the brain slice comprises an astrocyte, an oligodendrocyte, a microglial cell, a pericyte, a smooth-muscle cell (SMC), and/or an endothelial cell.

17. The method of claim 13, wherein the providing comprises administering to a living subject.

18. The method of claim 17, wherein the living subject is a human, non-human primate, or a mouse.

19. The method of claim 17, wherein the administering to a living subject is through injection.

20. The method of claim 19, wherein the injection comprises intravenous injection, intraparenchymal injection into brain tissue, intracerebroventricular (ICV) injection, intracisterna magna (ICM) injection, or intrathecal injection.

* * * * *